United States Patent
Wei et al.

(10) Patent No.: US 9,447,401 B2
(45) Date of Patent: Sep. 20, 2016

(54) PH20 POLYPEPTIDE VARIANTS, FORMULATIONS AND USES THEREOF

(71) Applicants: Ge Wei, San Diego, CA (US); H. Michael Shepard, San Diego, CA (US); Qiping Zhao, San Diego, CA (US); Robert James Connor, Oceanside, CA (US)

(72) Inventors: Ge Wei, San Diego, CA (US); H. Michael Shepard, San Diego, CA (US); Qiping Zhao, San Diego, CA (US); Robert James Connor, Oceanside, CA (US)

(73) Assignee: Halozyme, Inc., San Diego, CA (US)

( * ) Notice: Subject to any disclaimer, the term of this patent is extended or adjusted under 35 U.S.C. 154(b) by 387 days.

(21) Appl. No.: 13/694,731

(22) Filed: Dec. 28, 2012

(65) Prior Publication Data

US 2013/0302275 A1 Nov. 14, 2013
US 2014/0178330 A9 Jun. 26, 2014

Related U.S. Application Data

(60) Provisional application No. 61/796,208, filed on Nov. 1, 2012, provisional application No. 61/631,313, filed on Dec. 30, 2011.

(51) Int. Cl.

| | | |
|---|---|---|
| C12N 9/26 | (2006.01) | |
| C12N 15/00 | (2006.01) | |
| A61K 38/47 | (2006.01) | |
| A61K 38/28 | (2006.01) | |
| A61K 45/06 | (2006.01) | |
| A61K 9/00 | (2006.01) | |
| A61K 47/10 | (2006.01) | |
| C12Q 1/34 | (2006.01) | |
| A61K 38/00 | (2006.01) | |

(52) U.S. Cl.
CPC ............ *C12N 9/2474* (2013.01); *A61K 9/0019* (2013.01); *A61K 38/28* (2013.01); *A61K 38/47* (2013.01); *A61K 45/06* (2013.01); *A61K 47/10* (2013.01); *C12Q 1/34* (2013.01); *C12Y 302/01035* (2013.01); *G01N 2333/926* (2013.01); *G01N 2333/928* (2013.01)

(58) Field of Classification Search
None
See application file for complete search history.

(56) References Cited

U.S. PATENT DOCUMENTS

| | | | |
|---|---|---|---|
| 3,536,809 A | 10/1970 | Applezweig | 424/28 |
| 3,598,123 A | 8/1971 | Zaffaroni | 424/435 |
| 3,630,200 A | 12/1971 | Higuchi | 424/427 |
| 3,710,795 A | 1/1973 | Higuchi et al. | 424/424 |
| 3,845,770 A | 11/1974 | Theeuwes et al. | 424/427 |
| 3,916,899 A | 11/1975 | Theeuwes et al. | 424/424 |
| 4,002,531 A | 1/1977 | Royer | 435/188 |
| 4,008,719 A | 2/1977 | Theeuwes et al. | 424/427 |
| 4,044,126 A | 8/1977 | Cook et al. | 514/180 |
| 4,179,337 A | 12/1979 | Davis et al. | 435/181 |
| 4,364,923 A | 12/1982 | Cook et al. | 424/46 |
| 4,414,209 A | 11/1983 | Cook et al. | 514/180 |
| 4,475,901 A * | 10/1984 | Kraegen et al. | 604/67 |
| 4,769,027 A | 9/1988 | Baker et al. | 424/493 |
| 4,952,496 A | 8/1990 | Studier et al. | 435/91.41 |
| 4,980,286 A | 12/1990 | Morgan et al. | 435/371 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,073,543 A | 12/1991 | Marshall et al. | 514/21 |
| 5,120,548 A | 6/1992 | McClelland et al. | 424/473 |
| 5,122,614 A | 6/1992 | Zalipsky | 548/520 |
| 5,323,907 A | 6/1994 | Kalvelage | 206/531 |
| 5,324,844 A | 6/1994 | Zalipsky | 548/520 |
| 5,446,090 A | 8/1995 | Harris | 525/54.1 |
| 5,591,767 A | 1/1997 | Mohr et al. | 514/413 |
| 5,612,460 A | 3/1997 | Zalipsky | 530/391.9 |
| 5,639,476 A | 6/1997 | Oshlack et al. | 424/468 |
| 5,643,575 A | 7/1997 | Martinez et al. | 424/194.1 |
| 5,672,662 A | 9/1997 | Harris et al. | 525/408 |
| 5,674,533 A | 10/1997 | Santus et al. | 424/493 |
| 5,721,348 A | 2/1998 | Primakoff | 536/22.1 |
| 5,733,566 A | 3/1998 | Lewis | 424/426 |
| 5,766,581 A | 6/1998 | Bartley et al. | 424/85.1 |
| 5,795,569 A | 8/1998 | Bartley et al. | 424/85.1 |
| 5,808,096 A | 9/1998 | Zalipsky | 548/520 |
| 5,854,046 A | 12/1998 | Au-Young et al. | 435/201 |
| 5,900,461 A | 5/1999 | Harris | 525/54.11 |
| 5,919,455 A | 7/1999 | Greenwald et al. | 424/178.1 |
| 5,932,462 A | 8/1999 | Harris et al. | 435/188 |
| 5,958,750 A | 9/1999 | Au-Young et al. | 435/201 |
| 5,985,263 A | 11/1999 | Lee et al. | 424/85.2 |
| 5,990,237 A | 11/1999 | Bentley et al. | 525/54.2 |
| 6,057,110 A | 5/2000 | Au-Young et al. | 435/6 |
| 6,113,906 A | 9/2000 | Greenwald et al. | 424/194.1 |

(Continued)

FOREIGN PATENT DOCUMENTS

| | | |
|---|---|---|
| CN | 102065886 A | 5/2011 |
| EP | 0400472 | 12/1990 |

(Continued)

OTHER PUBLICATIONS

Have et al. (1998) Cloning and characterization of the cDNA encoding the PH20 protein in the European red fox *Vulpes vulpes*, Reproduct. Fertil. Dev., vol. 10, pp. 165-172.*

(Continued)

*Primary Examiner* — Manjunath Rao
*Assistant Examiner* — Samuel Liu
(74) *Attorney, Agent, or Firm* — Dentons US LLP; Stephanie Seidman

(57) ABSTRACT

Modified PH20 hyaluronidase polypeptides, including modified polypeptides that exhibit increased stability and/or increased activity, are provided. Also provided are compositions and formulations and uses thereof.

49 Claims, 13 Drawing Sheets

(56) References Cited

U.S. PATENT DOCUMENTS

| | | | |
|---|---|---|---|
| 6,193,963 B1 | 2/2001 | Stern et al. | 424/94.6 |
| 6,214,966 B1 | 4/2001 | Harris | 528/322 |
| 6,258,351 B1 | 7/2001 | Harris | 424/78.3 |
| 6,340,742 B1 | 1/2002 | Burg et al. | 530/351 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,461,863 B1 | 10/2002 | Jarvis | 435/320.1 |
| 6,495,659 B2 | 12/2002 | Bentley et al. | 528/425 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 7,105,330 B2 | 9/2006 | Stern et al. | 435/200 |
| 7,279,457 B2 | 10/2007 | Pohl | 514/3 |
| 7,585,940 B2 | 9/2009 | Skerra et al. | 530/350 |
| 7,767,429 B2 | 8/2010 | Bookbinder et al. | 435/201 |
| 7,781,397 B2 | 8/2010 | Stern et al. | 424/94.62 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 8,105,586 B2 | 1/2012 | Bookbinder et al. | 424/94.3 |
| 8,187,855 B2 | 5/2012 | Baker et al. | 435/201 |
| 8,202,517 B2 | 6/2012 | Bookbinder et al. | 424/94.62 |
| 8,257,699 B2 | 9/2012 | Bookbinder et al. | 424/94.62 |
| 8,318,154 B2 | 11/2012 | Frost et al. | 424/94.5 |
| 8,343,487 B2 | 1/2013 | Baker et al. | 424/94.62 |
| 8,401,194 B2 * | 3/2013 | Nierzwick et al. | 380/270 |
| 8,431,124 B2 | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,568,713 B2 | 10/2013 | Frost et al. | 424/94.5 |
| 8,580,252 B2 | 11/2013 | Bookbinder et al. | 424/85.2 |
| 8,765,685 B2 | 7/2014 | Bookbinder et al. | 514/20.9 |
| 8,772,246 B2 | 7/2014 | Bookbinder et al. | 435/200 |
| 9,284,543 B2 | 3/2016 | Wei et al. | 435/201 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0017108 A1 | 1/2003 | Zamora et al. | 424/1.49 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard et al. | 514/12 |
| 2004/0268425 A1 | 12/2004 | Bookbinder et al. | 800/18 |
| 2005/0054048 A1 | 3/2005 | Grasso et al. | 424/133.1 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.62 |
| 2006/0104968 A1 | 5/2006 | Bookbinder et al. | 424/94.62 |
| 2007/0067855 A1 | 3/2007 | Jarvis et al. | 800/13 |
| 2007/0189962 A1 | 8/2007 | Pastan | 424/133.1 |
| 2009/0042785 A1 | 2/2009 | Matschiner et al. | 514/12 |
| 2009/0123367 A1 | 5/2009 | Bookbinder et al. | 424/1.49 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2009/0304665 A1 | 12/2009 | Frost et al. | 424/94.5 |
| 2009/0305982 A1 | 12/2009 | Jensen et al. | 435/69.1 |
| 2009/0311237 A1 | 12/2009 | Frost et al. | 424/94.62 |
| 2010/0003238 A1 | 1/2010 | Frost et al. | 424/94.62 |
| 2010/0074885 A1 | 3/2010 | Schiff et al. | 424/130.1 |
| 2010/0143457 A1 | 6/2010 | Wei et al. | 424/450 |
| 2010/0172892 A1 | 7/2010 | Uvarkina et al. | 424/94.62 |
| 2011/0152359 A1 | 6/2011 | Bookbinder et al. | 435/200 |
| 2012/0020951 A1 | 1/2012 | Shepard et al. | 424/130.1 |
| 2012/0148555 A1 | 6/2012 | Bookbinder et al. | 435/200 |
| 2012/0171153 A1 | 7/2012 | Frost et al. | 424/94.62 |
| 2012/0213767 A1 | 8/2012 | Wei et al. | 424/450 |
| 2012/0251517 A1 | 10/2012 | Frost et al. | 424/94.62 |
| 2012/0251620 A1 | 10/2012 | Bookbinder et al. | 424/450 |
| 2012/0294830 A1 | 11/2012 | Bookbinder et al. | 424/85.2 |
| 2013/0011378 A1 | 1/2013 | Yang et al. | 424/94.3 |
| 2013/0022588 A1 | 1/2013 | Yang et al. | 424/94.3 |
| 2013/0022592 A1 | 1/2013 | Vaughn et al. | 424/94.62 |
| 2013/0058893 A1 | 3/2013 | Bookbinder et al. | 435/200 |
| 2013/0202583 A1 | 8/2013 | Jiang et al. | 424/94.62 |
| 2013/0251786 A1 | 9/2013 | Li et al. | 424/94.62 |
| 2013/0302400 A1 | 11/2013 | Maneval et al. | 435/195 |
| 2014/0037613 A1 | 2/2014 | Bookbinder et al. | 424/94.62 |
| 2014/0105824 A1 | 4/2014 | Shepard et al. | 424/9.2 |
| 2014/0135682 A1 | 5/2014 | Frost et al. | 424/94.5 |
| 2014/0199282 A1 | 7/2014 | Bookbinder et al. | 435/200 |
| 2015/0010529 A1 | 1/2015 | Wei | 424/94.62 |

FOREIGN PATENT DOCUMENTS

| | | |
|---|---|---|
| EP | 0822199 | 9/2004 |
| EP | 1064951 | 8/2007 |
| JP | 2007-153797 | 6/2007 |
| WO | WO 92/16640 | 10/1992 |
| WO | WO 94/28024 | 12/1994 |
| WO | WO 00/02017 | 1/2000 |
| WO | WO 01/87925 | 4/2001 |
| WO | WO 02/49673 | 6/2002 |
| WO | WO 2004/056312 | 7/2004 |
| WO | WO 2005/000360 | 1/2005 |
| WO | WO 2009/128917 | 10/2009 |
| WO | WO 2009/134380 | 11/2009 |
| WO | WO 2010/077297 | 7/2010 |
| WO | WO 2010/149772 | 12/2010 |
| WO | WO 2012/136768 | 11/2012 |
| WO | WO 2012/174478 | 12/2012 |
| WO | WO 2013/102144 | 7/2013 |
| WO | WO 2015/003167 | 1/2015 |

OTHER PUBLICATIONS

Attachment M3WD76 Felca (2015, updated) Hyaluronidase/PH20 from Felis catus, pp. 1-3.*

U.S. Appl. No. 13/999,454, filed Feb. 26, 2014.

U.S. Appl. No. 14/120,224, filed May 7, 2014.

U.S. Appl. No. 14/323,932, filed Jul. 3, 2014.

Letter/Written Disclosure of the Supplemental Information Disclosure Statement for the above-referenced application, mailed Jul. 10, 2014, 2 pages.

Maksimenko et al. "Resistance of dextran-modified hyaluronidase to inhibition by heparin," Biochemistry (Mosc). 66(4):456-463 (2001).

Reitinger et al., "Designed human serum hyaluronidase 1 variant, HYAL1DeltaL, exhibits activity up to pH 5.9," J Biol Chem. 284(29):19173-19177 (2009).

Schantéet al., "Improvement of hyaluronic acid enzymatic stability by the grafting of amino-acids," Carbohydrate Polymers, 87(3):2211-2216 (2012).

Jiang et al., "Effects of recombinant human PH20 (rHuPH20) on interstitial matrices: creating a favorable environment for the delivery of cytostatic agents," [abstract]. In: Proceedings of the 96th Annual Meeting of the American Association for Cancer Research; Apr. 16-20, 2005; Anaheim, CA.:AACR; 2005. vol. 46, p. 1198, Abstract No. 5075, XP001525054, Apr. 2005.

Morrow et al., "Human hyaluronidase coinjection accelerates insulin pharmacokinetics and glucodynamics of 3 rapid insulin analogs," American Diabetes Association Scientific Sessions, held on Jun. 28, 2010 in Orlando, FL., Abstract # 353-OR, 2 pages.

Nagy, Z., "Prospective study on rHuPH20," European Society of Human Reproduction & Embryology Annual Meeting, Jun. 19-22, 2005, Copenhagen, Denmark. Abstract O-213 (2005), 1 page.

Partial International Search Report, sent by facsimile Sep. 4, 2013, in connection with corresponding International Patent Application No. PCT/US2012/072182, 6 pages.

International Search Report and Written Opinion, mailed Dec. 17, 2013, in connection with corresponding International Patent Application No. PCT/US2012/072182, 18 pages.

(56) References Cited

OTHER PUBLICATIONS

Response, dated Mar. 17, 2014, to Written Opinion, mailed Dec. 17, 2013, in connection with corresponding International Patent Application No. PCT/US2012/072182, 94 pages.
Second Written Opinion, mailed May 21, 2014, in connection with corresponding International Patent Application No. PCT/US2012/072182, 8 pages.
Letter/Written Disclosure of the Supplemental Information Disclosure Statement for the above-referenced application, filed herewith Oct. 20, 2014, 2 pages.
Morrow et al., "Human hyaluronidase coinjection accelerates insulin pharmacokinetics and glucodynamics of 3 rapid insulin analogs," American Diabetes Association Scientific Sessions, held on Jun. 28, 2010 in Orlando, FL, Abstract # 353-OR, 2 pages.
Second Written Opinion, mailed Jul. 30, 2014, in connection with International Patent Application No. PCT/US2012/072182, 9 pages.
Response, dated Sep. 1, 2014, to Second Written Opinion, mailed Jul. 30, 2014, in connection with International Patent Application No. PCT/US2012/072182, 73 pages.
International Preliminary Report on Patentability, mailed Sep. 12, 2014, in connection with International Patent Application No. PCT/US2012/072182, 11 pages.
Letter/Written Disclosure of the Supplemental Information Disclosure Statement for the above-referenced application, filed herewith Sep. 2, 2015, 2 pages.
"PEGPH20: The Science & The Strategy," presented at the J. P. Morgan Healthcare Conference on Jan. 7, 2015, 81 pages.
Torley, H., "Halozyme Therapeutics, Inc. The next chapter begins: creating value through growth," presented at the 32nd Annual J.P. Morgan Healthcare Conference Jan. 7, 2014, 26 pages.
News Release, "Halozyme announces presentation of clinical data at the American Diabetes Association 74th Scientific Sessions," Published on Jun. 15, 2014 [online]Retrieved from:<URL: halozyme.com/Investors/News-Releases/News-Release-Details/2014/Halozyme-Announces-Presentation-Of-Clinical-Data-At-The-American-Diabetes-Association-74th-Scientific-Sessions/default.aspx [retrieved on Aug. 18, 2014], 3 pages.
Response, dated Jul. 21, 2014, to second Written Opinion, mailed May 21, 2014, in connection with International Patent Application No. PCT/US2012/072182, 72 pages.
Office Action, issued May 25, 2015, in connection with Chinese Patent Application No. 201280070954.9 [English language translation and original document in Chinese], 7 pages.
U.S. Appl. No. 13/507,540, filed Jul. 6, 2012.
U.S. Appl. No. 13/694,005, filed Oct. 18, 2012.
U.S. Appl. No. 13/694,071, filed Oct. 24, 2012.
U.S. Appl. No. 13/815,311, filed Feb. 19, 2013.
Letter/Written Disclosure of the Supplemental Information Disclosure Statement for the above-referenced application, filed herewith Apr. 8, 2013, 2 pages.
Adams et al., "The c-myc oncogene driven by immunoglobulin enhancers induces lymphoid malignancy in transgenic mice," Nature 318:533-538 (1985).
Alexander et al., "Expression of the c-myc oncogene under control of an immunoglobulin enhancer in E mu-myc transgenic mice," Mol. Cell Biol. 7:1436-1444 (1987).
Ansel, H., *Introduction to Pharmaceutical Dosage Forms*, Fourth Edition, Lea & Febiger:Philadelphia, p. 126 (1985).
Anttila et al., "High levels of stromal hyaluronan predict poor disease outcome in epithelial ovarian cancer," Cancer Rearch 60:150-155 (2000).
Arming et al., "In vitro mutagenesis of PH-20 hyaluronidase from human sperm," Eur J Biochem 247(3):810-814 (1997).
Atkinson, M. And E. Leiter, "The NOD mouse model of type 1 diabetes: as good as it gets?" Nature Med. 5:601-604 (1999).
Auvinen, P. "Hyaluronan in peritumoral stroma and malignant cells associates with breast cancer spreading and predicts survival," American Journal of Pathology 156(2):529-536 (2000).

Baumgartner et al., "Phase I study in chemoresistant loco-regional malignant disease with hyaluronidase," Reg. Cancer Treat. 1:55-58 (1988).
Beckenlehner et al., "Hyaluronidase enhances the activity of adriamycin in breast cancer models in vitro and in vivo," J. Cancer Res. Oncol. 118:591-596 (1992).
Benhar et al., "Pseudomonas exotoxin A mutants. Replacement of surface-exposed residues in domain III with cysteine residues that can be modified with polyethylene glycol in a site-specific manner," J. Biol. Chem. 269:13398-13404 (1994).
Bianchi et al., "Synthetic depsipeptide substrates for the assay of human hepatitis C virus protease," Anal. Biochem. 237: 239-244 (1996).
Bitter et al., "Expression and secretion vectors for yeast," Methods in Enzymol 153:516-544 (1987).
Bonner, W. and E. Cantey, "Colorimetric method for determination of serum hyaluronidase activity," Clin. Chim. Acta 13:746-752 (1966).
Bookbinder et al., "A recombinant human enzyme for enhanced interstitial transport of therapeutics," J Control Release, 114:230-241 (2006).
Bordier C., "Phase separation of integral membrane proteins in Triton X-114 solution," J Biol Chem. 256(4):1604-1607 (1981).
Bouffard et al., "An in vitro assay for hepatitis C virus NS3 serine proteinase," Virology 209:52-59 (1995).
Brinster et al., "Regulation of metallothionein—thymidine kinase fusion plasmids injected into mouse eggs," Nature 296:39-42 (1982).
Brown et al., "Codon utilisation in the pathogenic yeast, *Candida albicans*," Nucleic Acids Res. 19(15):4298 (1991).
Brumeanu et al., "Derivatization with monomethoxypolyethylene glycol of Igs expressing viral epitopes obviates adjuvant requirements," J Immunol. 154:3088-3095 (1995).
Caliceti, P. and F. Veronese, "Pharmacokinetic and biodistribution properties of poly(ethylene glycol)-protein conjugates,"Adv. Drug Deliv. Rev. 55(10):1261-1277 (2003).
Carrillo, H. and D. Lipman, "The multiple-sequence alignment problem in biology," SIAM J Applied Math 48:1073-1082 (1988).
Cefalu, W., "Animal models of type 2 diabetes: clinical presentation and pathophysiological relevance to the human condition," ILAR Journal 47(3):186-198 (2006).
Chapman et al., "Therapeutic antibody fragments with prolonged in vivo half-lives," Nature Biotech. 17:780-783 (1999).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol. 20:515-525 (2001).
Cherr et al., "The PH-20 protein in cynomolgus macaque spermatozoa: identification of two different forms exhibiting hyaluronidase activity," Dev. Biol., 175:142-153, 1996.
Cho et al., "Construction of hepatitis C-SIN virus recombinants with replicative dependency on hepatitis C virus serine protease activity," J. Virol. Meth. (65):201-207 (1997).
Chowpongpang et al., "Cloning and characterization of the bovine testicular PH-20 hyaluronidase core domain," Biotechnol Lett. 26(15):1247-1252 (2004).
Colbere-Garapin et al., "A new dominant hybrid selective marker for higher eukaryotic cells," J Mol Biol 150:1-14 (1981).
Conserved domain search from U.S. Appl. No. 10/795,095 of SEQ ID No. 6, Primakoff et al. U.S. Pat. No. 5,721,348, performed on the NCBI website on Aug. 5, 2008.
Csoka et al., "Hyaluronidases in tissue invasion," Invasion Metastasis 17:297-311 (1997).
Csoka et al., "Purification and microsequencing of hyaluronidase isozymes from human urine," FEBS Lett., 417(3):307-310 (1997).
Csoka et al., "The six hyaluronidase-like genes in the human and mouse genomes," Matrix Biol. 20:499-508 (2001).
Czejka et al., "Influence of hyaluronidase on the blood plasma levels of 5-fluorouracil in patients," Pharmazie 45:H.9 (1990).
De Maeyer et al., "The growth rate of two transplantable murine tumors, 3LL lung carcinoma and B16F10 melanoma, is influenced

(56) References Cited

OTHER PUBLICATIONS by Hyal-1, a locus determining hyaluronidase levels and polymorphism," Int. J. Cancer 51:657-660 (1992).
De Salegui et al., "A comparison of serum and testicular hyaluronidase," Arch. Biochem. Biophys. 121:548-554 (1967).
DeBoer et al., "The tac promoter: a functional hybrid derived from the trp and lac promoters," Proc. Natl. Acad. Sci. USA 80:21-25 (1983).
Delpech et al., "Enzyme-linked hyaluronectin: a unique reagent for hyaluronan assay and tissue location and for hyaluronidase activity detection," Anal. Biochem. 229:35-41 (1995).
Dorfinan, A. and M. Ott, "A turbidimetric method for the assay of hyaluronidase," J. Biol. Chem. 172:367-375 (1948).
D'Souza et al., "In vitro cleavage of hepatitis C virus polyprotein substrates by purified recombinant NS3 protease," J. Gen. Virol. 76:1729-1736 (1995).
Duttaroy et al., "Development of a long-acting insulin analog using albumin fusion technology," Diabetes 54(1):251-258 (2005).
Elder et. al, "Intra-arterial hyaluronidase in severe peripheral arterial disease," Lancet 648-649 (1980).
Ernst et al., "Enzymatic degradation of glycosaminoglycans," Critical Reviews in Biochemistry and Molecular Biology 30(5):387-444 (1995).
European Pharmacopoeia, Chapter 5.1.3, "Efficacy of antimicrobial preservation," 447-449 (2005).
Fankhauser, N. and P.Mäser, "Identification of GPI anchor attachment signals by a Kohonen self-organizing map," Bioinformatics 21(9) 1846-1852 (2005).
Felix et al., "Pegylated peptides. IV. Enhanced biological activity of site-directed pegylated GRF analogs," Int. J. Peptide Res. 46:253-264 (1995).
Few, B., "Hyaluronidase for treating intravenous extravasations," MCN Amer. J. Matern. Child Nurs. 12(1):23 (1987).
Filocamo et al., "Chimeric Sindbis viruses dependent on the NS3 protease of hepatitis C virus," J.Virology 71:1417-1427 (1997).
Forsburg, S., "Codon usage table for Schizosaccharomyces pombe," Yeast. 10(8):1045-1047 (1994).
Fransson et al., "Solvent effects on the solubility and physical stability of human insulin-like growth factor I," Pharm Res. 14(5):606-612 (1997).
Frost, G. and R. Stern, "A microtiter-based assay for hyaluronidase activity not requiring specialized reagents," Anal. Biochem. 251:263-269 (1997).
Gardner et al., "The complete nucleotide sequence of an infectious clone of cauliflower mosaic virus by M13mp7 shotgun sequencing," Nucleic Acids Res. 9:2871-2888 (1981).
GenBank Accession No. AAC60607, PH-20 [*Homo sapiens*], published on Jun. 5, 2000 [online] [retrieved on Dec. 12, 2012][retrieved from the Internet: URL:<ncbi.nlm.nih.gov/protein/AAC60607], 1 page.
Gilbert, W. and L. Villa-Komaroff, "Useful Proteins from Recombinant Bacteria," Scientific American 242(4):74-94 (1980).
Girish et al., "Hyaluronidase inhibitors: a biological and therapeutic perspective," Curr Med Chem 16(18):2261-2288 (2009).
Gmachl et al., "The human sperm protein PH-20 has hyaluronidase activity," FEBS 336(3):545-548 (1993).
Good et al., "Hydrogen ion buffers for biological research," Biochemistry 5(2):467-477 (1966).
Gribskov et al., "Sigma factors from *E. coli, B. subtilis*, phage Sp01, and phage T4 are homologous proteins," Nucl. Acids Res. 14(16):6745-6763 (1986).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Guntenhoner et al., "A substrate-gel assay for hyaluronidase activity," Matrix 12:388-396 (1992).

Guo et al., "Protein tolerance to random amino acid change," Proc. Nat'l. Acad. Sci. USA 101:9205-9210 (2004).
Hahm et al., "Generation of a novel poliovirus with a requirement of hepatitis C virus protease NS3 activity," Virology 226:318-326 (1996).
Haller et al., "Escaping the interstitial matrix with enzyme-mediated drug delivery," Drug Delivery Technology, 5(5):1-6 (2005).
Hamatake et al., "Establishment of an in vitro assay to characterize hepatitis C virus NS3-4A protease trans-processing activity ," Intervirology 39:249-258 (1996).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315(6015):115-122 (1985).
Harris, J. and R. Chess, "Effect of pegylation on pharmaceuticals," Nat Rev Drug Discov 2(3):214-221 (2003).
Hartman S. and R. Mulligan, "Two dominant-acting selectable markers for gene transfer studies in mammalian cells," Proc Natl Acad Sci 85:8047-8051 (1988).
Herrera-Estrella et al., "Expression of chimaeric genes transferred into plant cells using a ti-plasmid-derived vector,"Nature 303:209-213 (1984).
Herrera-Estrella et al., "Light-inducible and chloroplast-associated expression of a chimaeric gene introduced into Nicotiana tabacum using a Ti plasmid vector," Nature 310(5973):115-120 (1984).
Hibi et al., "Chondroitinase C activity of *Streptococcus intermedius*," FEMS-Microbiol-Lett. 48(2):121-124 (1989).
Hofinger et al., "Isoenzyme-specific differences in the degradation of hyaluronic acid by mammalian-type hyaluronidases," Glycoconj J 25:101-109 (2008).
Holash et al., "VEGF-Trap: a VEGF blocker with potent antitumor effects," Proc Nati Acad Sci U S A. 99(17):11393-11398 (2002).
Hooper et al., "Determination of glycosyl-phosphatidylinositol membrane protein anchorage" Proteomics 1:748-755 (2001).
Horn et al., "Intravesical chemotherapy of superficial bladder tumors in a controlled trial with cis-platinum versus cis-platinum plus hyaluronidase," J. Surg. Oncol. 28:304-307 (1985).
Huang, X. and M. Miller. "A time-efficient, linear-space local similarity algorithm." Adv. Appl. Math. 12:337-357 (1991).
Hunnicut et al., "Structural relationship of sperm soluble hyaluronidase to the sperm membrane protein PH-20," Biol Reprod. 54(6):1343-1349 (1996).
Ito et al., "Cultivation of hepatitis C virus in primary hepatocyte culture from patients with chronic hepatitis C results in release of high titre infectious virus," J. Gen. Virol. 77:1043-1054 (1996).
IUPAC-IUB Commission on Biochemical Nomenclature, "A One-Letter Notation for Amino Acid Sequences: Tentative Rules," J. Biol. Chem. 243:3557-3559 (1968).
IUPAC-IUB, "Abbreviated nomenclature of synthetic poypeptides-polymerized amino acids-revised recommendations," Commission on Biochemical Nomenclature, Biochemistry 11:1726-1731 (1972).
Jay et al., "Construction of a general vector for efficient expression of mammalian proteins in bacteria: use of a synthetic ribosome binding site," Proc. Natl. Acad. Sci. USA 78:5543-5548 (1981).
Karvinen et al., "Hyaluronan, CD44 and versican in epidermal keratinocyte tumors," British Journal of Dermatology 148:86-94 (2003).
Kelsey et al., "Species- and tissue-specific expression of human alpha 1-antitrypsin in transgenic mice," Genes and Devel. 1:161-171 (1987).
Kim et al., "Sperm penetration through cumulus mass and zona pellucida," Int J Dev Biol. 52(5-6):677-682 (2008).
Kodukula et al., "Biosynthesis of phosphatidylinositol glycan-anchored membrane proteins" J. Biol. Chem. 266:4464-4470 (1991).
Kohno et al., "Effects of hyaluronidase on doxorubicin penetration into squamous carcinoma multicellular tumor spheroids and its cell lethality," J. Cancer Res. Oncol. 120:293-297 (1994).
Kollias et al., "Regulated expression of human A gamma-, beta-, and hybrid gamma beta-globin genes in transgenic mice: manipulation of the developmental expression patterns," Cell 46:89-94 (1986).

(56) References Cited

OTHER PUBLICATIONS

Krumlauf et al., Developmental regulation of alpha-fetoprotein genes in transgenic mice, Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32(6):785-790 (1996).
Kyte et al., "A Simple Method for Displaying the Hydropathic Character of a Protein" J. Mol. Biol. 157:105-132 (1982).
Lalancette et al, "Characterization of an 80-kilodalton bull sperm protein identified as PH-20," Biol Reprod. 65(2):628-636 (2001).
Lam et al., "The effect of benzyl alcohol on recombinant human interferon-gamma," Pharm Res. 14(6):725-729 (1997).
Lammerts van Bueren et al., "The antibody zalutumumab inhibits epidermal growth factor receptor signaling by limiting intra- and intermolecular flexibility," Proc Natl Acad Sci U S A. 105(16):6109-6114 (2008). Retraction also included, Proc Natl Acad Sci U S A. 109(14):5548 (2008).
Lathrop et al., "cDNA cloning reveals the molecular structure of a sperm surface protein, PH-20, involved in sperm-egg adhesion and the wide distribution of its gene among mammals," J Cell Biol. 111(6 Pt 2):2939-2949 (1990).
Laurent, T. and J. Fraser, "Hyaluronan," FASEB J 6:2397-2404 (1992).
Leder et al., "Consequences of widespread deregulation of the c-myc gene in transgenic mice: multiple neoplasms and normal development," Cell 45:485-495 (1986).
Li et al., "Importance of glycosylation and disulfide bonds in hyaluronidase activity of macaque sperm surface PH-20," J. Androl. 23:211-219 (2002).
Li et al., "Structural basis for EGF receptor inhibition by the therapeutic antibody IMC-11F8," Structure. I6(2):216-227 (2008).
Liang et al., "Prediction of antigenic epitopes on protein surfaces by consensus scoring," BMC Bioinformatics. 10:302, 10 pages (2009).
Lin et al., "A hyaluronidase activity of the sperm plasma membrane protein PH-20 enables sperm to penetrate the cumulus cell layer surrounding the egg," J Cell Biol. 125(5):1157-1163 (1994).
Lin et al., "Molecular cloning of the human and monkey sperm surface protein PH-20," Proc. Natl. Acad. Sci. USA 90:10071-10075 (1993).
Lipponen et al "High stromal hyaluronan level is associated with poor differentiation and metastasis in prostate cancer," European Journal of Cancer 37:849-856 (2001).
Louveau, I. and F. Gondret, "GH and insulin affect fatty acid synthase activity in isolated porcine adipocytes in culture without any modifications of sterol regulatory element binding protein-1 expression," J Endocrin. 181:271-280 (2004).
Lowy et al., "Isolation of transforming DNA: cloning the hamster aprt gene," Cell 22:817-823 (1980).
Lu, H. and E. Wimmer., "Poliovirus chimeras replicating under the translational control of genetic elements of hepatitis C virus reveal unusual properties of the internal ribosomal entry site of hepatitis C virus," Proc. Natl. Acad. Sci. USA 93:1412-1417 (1996).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
Ma et al., "Fucosylation in prokaryotes and eukaryotes" Glycobiology 16(12):158R-184R (2006).
Maa and Hsu, "Aggregation of recombinant human growth hormone induced by phenolic compounds" Int. J. Pharm. 140(2):155-168 (1996).
MacDonald, R., "Expression of the pancreatic elastase I gene in transgenic mice," Hepatology 7:42S-51S(1987).
Magram et al., "Developmental regulation of a cloned adult beta-globin gene in transgenic mice," Nature 315:338-340 (1985).
Mammalian Gene Collection (MGC) Program Team, "Generation and initial analysis of more than 15,000 full-length human and mouse cDNA sequences," Proc. Natl. Acad. Sci. USA 99:16899-16903 (2002).
McIlvaine, WB, "A buffer solution for colorimetric comparison," J. Biol. Chem. 49:183-186 (1921).
Mehvar et al., "Modulation of the pharmacokinetics and pharmacodynamics of proteins by polyethylene glycol conjugation," J. Pharm. Pharmaceut. Sci. 3(1):125-136 (2000).
Menzel, E. and C. Farr, "Hyaluronidase and its substrate hyaluronan: biochemistry, biological activities and therapeutic uses," Cancer Lett., 131:3-11 (2003).
Merrifield, J., "Solid phase peptide synthesis. I. The synthesis of a tetrapeptide," J Am Chem Soc 85:2149-2154 (1963).
Meyer et al., "The soluble hyaluronidase from bull testes is a fragment of the membrane-bound PH-20 enzyme." FEBS Letters 413(2):385-388 (1997).
Michelacci et al., "Chondroitinase C from Flavobacterium heparinum," J. Biol. Chem. 251:1154-1158 (1976).
Miller et al., "Use of retroviral vectors for gene transfer and expression," Meth. Enzymol. 217:581-599 (1993).
Mizutani et al., Characterization of hepatitis C virus replication in cloned cells obtained from a human T-cell leukemia virus type 1-infected cell line, MT-2, J.Virol. 70:7219-7223 (1996).
Mizutani et al., "Inhibition of hepatitis C virus replication by antisense oligonucleotide in culture cells," Biochem. Biophys. Res. Commun. 212:906-911 (1995).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6:62-69 (1995).
Nadjsombati et al., "Dose-range developmental toxicity of rHuPH20 in mice," Matrix Biology, 27:23 (2008).
Nakayama et al., "CD15 expression in mature granulocytes is determined by alpha 1,3-fucosyltransferase LX, but in promyelocytes and monocytes by alpha 1,3-fucosyltransferase IV," J. Biol. Chem., 276(19):16100-16106 (2001).
Needleman, S. and C. Wunsch "A general method applicable to the search for similarities in the amino acid sequence of two proteins," J Mol Biol. 48:443-453 (1970).
Omaetxebarria et al., "Computational approach for identification and characterization of GPI-anchored peptides in proteomics experiments," Proteomics 7(12):1951-1960 (2007).
Omitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Ostresh et al., "Peptide libraries: determination of relative reduction rates of protected amino acids in competitive couplings," Biopolymers 34:1681-1689 (1994).
Padavattan, S. "Crystal structure determination of hyaluronidase : a major bee venom allergen, in complex with an IgG Fab fragment and purification and biophysical characterization of bovine testes hyaluronidase," 2006, PhD Thesis, University of Basel, Faculty of Science. DOI: 10.5451/unibas-004349798. 98 pages.
Paul, A. and D. Sochart, "Improving the results of ganglion aspiration by the use of hyaluronidase," J Hand Surg 22(2):219-221 (1997).
Paulick, M. and C. Bertozzi, "The glycosylphosphatidylinositol anchor: A complex membrane-anchoring structure for proteins," Biochemistry 47:6991-7000 (2008).
Pawlowski et al., "The effects of hyalurodinase upon tumor formation in BALB/c mice painted with 7,12-dimethylbenz-(a)anthracene," Int. J. Cancer 23:105-109 (1979).
Pedersen et al., "Sym004: a novel synergistic anti-epidermal growth factor receptor antibody mixture with superior anticancer efficacy," Cancer Res. 70(2):588-597 (2010).
Pham et al., "Large-scale transient transfection of serum-free suspension-growing HEK293 EBNA1 cells: peptone additives improve cell growth and transfection efficiency," Biotechnology and Bioengineering 84:332-342 (2003).

(56) References Cited

OTHER PUBLICATIONS

Phelps et al., "Restricted lateral diffusion of PH-20, a PI-anchored sperm membrane protein," Science 240:1780-1782 (1988).
Pierleoni et al., PredGPI: a GPI-anchor predictor, BMC Bioinformatics 9:392 (2008).
Pinkert et al., "An albumin enhancer located 10 kb upstream functions along with its promoter to direct efficient, liver-specific expression in transgenic mice," Genes and Devel. 1:268-276 (1987).
Pirinen et al "Prognostic value of hyaluronan expression in non-small cell lung cancer: Increased stromal expression indicated unfavorable outcome in patients with adenocarcinoma" Int. J. Cancer 95, 12-17 (2001).
Primakoff et al., "Fully effective contraception in male and female guinea pigs immunized with the sperm protein PH-20," Nature 335:543-546 (1988).
Readhead et al., "Expression of a myelin basic protein gene in transgenic shiverer mice: correction of the dysmyelinating phenotype," Cell 48:703-712 (1987).
Remmele et al., "Interleukin-1 receptor (IL-IR) liquid formulation development using differential scanning calorimetry," Pharm Res. 15(2):200-208 (1998).
Rhodes et al., "Transformation of maize by electroporation of embryos," Methods Mol Biol 55:121-131 (1995).
Richmond, T., "Precompiled codon-usage tables," Genome Biology 1(1):reports241, 2 pages (2000).
Ripka et al., "Two Chinese hamster ovary glycosylation mutants affected in the conversion of GDP-mannose to GDP-fucose," Arch. Biochem. Biophys. 249(2):533-545 (1986).
Roberts et al., "Chemistry for peptide and protein PEGylation," Advanced Drug Delivery Review 54:459-476 (2002).
Ropponen et al "Tumor Cell-associated Hyaluronan as an Unfavorable Prognostic Factor in Colorectal Cancer" Cancer Research 58:342-347 (1998).
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Scharf et al., "Heat stress promoters and transcription factors," Results Probl Cell Differ 20:125-162 (1994).
Scheithauer et al., "In vitro evaluation of the anticancer drug modulatory effect of hyaluronidase in human gastrointestinal cell lines," Anticancer Res. 8:391-396 (1988).
Schuller et al., "Pharmacokinetics of intrahepatic 5-fluorouracil + preinjected hyaluronidase," Proc. Amer. Assoc. Cancer Res. 32:173, abstract No. 1034 (1991).
Schwartz and Dayhoff, eds., Atlas of Protein Science and Structure, National Biomedical Research Foundation, pp. 353-358 (1979).
Schwartzman, J., "Hyaluronidase: A Review in Its Therapeutic Use in Pediatrics," J. Pediat. 39:491-502 (1951).
Seaton et al., "Rat sperm 2B1 glycoprotein (PH20) contains a C-terminal sequence motif for attachment of a glycosyl phosphatidylinositol anchor. Effects of endoproteolytic cleavage on hyaluronidase activity," Biol Reprod. 62(6):1667-1676 (2000).
Shani, M., "Tissue-specific expression of rat myosin light-chain," Nature 314:283-286 (1985).
Sharp et al., "Codon usage patterns in *Escherichia coli, Bacillus subtilis, Saccharomyces cerevisiae, Schizosaccharomyces pombe, Drosophila melanogaster* and *Homo sapiens*; a review of the considerable within-species diversity," Nucleic Acids Res. 16(17):8207-8211 (1988).
Sharp, P. and E. Cowe, "Synonymous codon usage in *Saccharomyces cerevisiae*," Yeast. 7(7):657-678 (1991).
Shekhar et al., "The matrix reloaded: halozyme's recombinant enzyme helps injected drugs spread faster," Chem. Biol. 14:603-604 (2007).

Shimizu, Y. and H. Yoshikura, "Multicycle infection of hepatitis C virus in cell culture and inhibition by alpha and beta interferons," J. Virol. 68:8406-8408 (1994).
Singh et al., "Mechanisms of m-cresol-induced protein aggregation studied using a model protein cytochrome c," J Pharm Sci. 100(5):1679-1689 (2011) Epub date Jan. 12, 2011.
Smith, T. and M. Waterman, "Comparison of biosequences," Advances in Applied Mathematics 2:482-489 (1981).
St Croix et al., "Reversal of intrinsic and acquired forms of drug resistance by hyaluronidase treatment of solid tumors," Cancer Lett 131(1):35-44 (1998).
Steinlcuhler et al., "Product inhibition of the hepatitis C virus NS3 protease," Biochem. 37:8899-8905 (1998).
Stern, R., "Devising a pathway for hyaluronan catabolism: are we there yet?" Glycobiology 13:105R-115R (2003).
Sturla et al., "Core fucosylation of N-linked glycans in leukocyte adhesion deficiency/congenital disorder of glycosylation IIc fibroblasts," Glycobiology I5(10):924-935 (2005).
Sudo et al., "Establishment of an in vitro assay system for screening hepatitis C virus protease inhibitors using high performance liquid chromatography," Antiviral Res. 32:9-18 (1996).
Sutton, S. and D. Porter, "Development of the antimicrobial effectiveness as USP chapter <51>," PDA J. Pharm. Sci Technol., 56(6):300-311 (2002).
Swift et al., "Tissue-specific expression of the rat pancreatic elastase I gene in transgenic mice," Cell 38(3):639-646 (1984).
Takahashi et al., "A fluorimetric Morgan-Elson assay method for hyaluronidase activity," Anal. Biochem. 322:257-263 (2003).
Takeshita et al., "An enzyme-linked immunosorbent assay for detecting proteolytic activity of hepatitis C virus proteinase," (1997) Anal. Biochem. 247:242-246.
Taliani et al., "A continuous assay of hepatitis C virus protease based on resonance energy transfer depsipeptide substrates," Anal. Biochem. 240:60-67 (1996).
ten Have et al., "Cloning and characterization of the cDNA encoding the PH20 protein in the European red fox *Vulpes vulpes*," Reprod Fertil Dev. 10(2):165-172 (1998).
Tkalec et al., "Isolation and expression in *Escherichia coli* of cs1A and cs1B, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification.," J Biol. Chem 279(37):38118-38124 (2004).
Tsuda et al., "Substrate specificity studies of flavobacterium chondroitinase C and heparitinases towards the glycosaminoglycan-protein linkage region. Use of a sensitive analytical method developed by chromophore-labeling of linkage glycoserines using dimethylaminoazobenzenesulfonyl chloride," Eur. J. Biochem. 262:127-133 (1999).
Tung et al., "Mechanism of infertility in male guinea pigs immunized with sperm PH-20," Biol. Reprod. 56(5):1133-1141 (1997).
Udenfriend, S. and K. Kodukula, "Prediction of omega site in nascent precursor of glycosylphosphatidylinositol protein," Methods Enzymol. 250:571-582 (1995).
UniProt Murine PH20 sequence, Retrieved from the Internet: <URL: uniprot.org/uniprot/P48794 [retrieved on Sep. 1, 2010] [5 pages].
United States Pharmacopeia. USP <51>. Antimicrobial effectiveness testing. United States Pharmacopeia Convention, Inc, Rockville, MD., 5 pages.
USP XXII-NF XVII, United States Pharmacopeia Convention, Inc, Rockville, MD., pp. 644-645 (1990).
Varela et al., "Exome sequencing identifies frequent mutation of the SWI/SNF complex gene PBRM1 in renal carcinoma,"Nature. 469(7331):539-542 (2011).
Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:197-207 (1997).

(56) References Cited

OTHER PUBLICATIONS

Wagner et al., "Nucleotide sequence of the thymidine kinase gene of herpes simplex virus type 1," Proc. Natl. Acad. Sci. USA 78:1441-1445 (1981).
Wang et al., "The molecular physiology of hepatic nuclear factor 3 in the regulation of gluconeogenesis," J. Biol Chem. 275(19):14717-14721 (2000).
Watson et al., Molecular Biology of the Gene, 4th Edition, The Benjamin/Cummings Pub. Co., p. 224 (1987).
Weiss et al., "Activities of monomeric insulin analogs at position A8 are uncorrelated with their thermodynamic stabilities," J. Biol. Chem. 276(43):40018-40024 (2001).
White et al., "Comparison of the glycosyl-phosphatidylinositol cleavage/attachment site between mammalian cells and parasitic protozoa," J. Cell Sci. 113(Pt.4):721-727 (2000).
Wigler et al., "Transfer of purified herpes virus thymidine kinase gene to cultured mouse cells," Cell 11:223-232 (1977).
Wigler et al., "Transformation of mammalian cells with an amplifiable dominant-acting gene," Proc Natl Acad Sci. USA 77:3567-3570 (1980).
Yamamoto et al., "Identification of a functional promoter in the long terminal repeat of Rous sarcoma virus," Cell 22:787-797 (1980).
Yamane-Ohnuki et al., "Establishment of FUT8 knockout Chinese hamster ovary cells: an ideal host cell line for producing completely defucosylated antibodies with enhanced antibody-dependent cellular cytotoxicity," Biotech. Bioeng. 87:614-622 (2004).
Yang, X. and X. Yu, "An introduction to epitope prediction methods and software," Rev Med Virol. 19(2):77-96 (2009).
Yocum et al., "Assessment and implication of the allergic sensitivity to a single dose of recombinant human hyaluronidase injection: A double-blind placebo-controlled clinical trial," J Infus Nursing 30:293-299 (2007).
Yudin et al., "Characterization of the active site of monkey sperm hyaluronidase," Reproduction. 121(5):735-743 (2001).
Zalipsky, S., "Chemistry of polyethylene glycol conjugates with biologically active molecules," Adv. Drug Del. Rev. 16:157-182 (1995).
Zanker et al., "Induction of response in previous chemotherapy resistant patients by hyaluronidase," Proc. Amer. Assoc. Cancer Res. 27:390 Abstract 1550 (1986).
Zhao, X. and J. Harris, "Novel degradable poly(ethylene glycol) esters for delivery," in Poly(ethylene glycol), Chemistry and Biological Applications, ACS Symposium Series 680, Hams, J. and S. Zalipsky, (eds), 458-472 (1997).
Bee et al., "Recombinant human PH20 is well tolerated at higher intravenous and subcutaneous doses in cynomolgus monkeys," EUFEPS 2008, Munich, Germany. Abstract, 2 pages.
Bee et al., "Recombinant human PH20 is well tolerated at higher intravenous and subcutaneous doses in cynomolgus monkeys " EUFEPS 2008, Munich, Germany. Poster, 1 page.
Bookbinder et al., "Biochemical characterization of recombinant human PH20 (SPAM1) hyaluronidase," Hyaluronan (ISHAS) 2007, Charleston, SC. Abstract, 1 page.
Bookbinder et al., "Biochemical characterization of recombinant human PH20 (SPAM1) hyaluronidase," Hyaluronan (ISHAS) 2007, Charleston, SC. Poster, 1 page.
Bookbinder et al., "Enhancing drug transport through temporary matrix depolymerization," Keystone Symposia 2005. (poster—12 pages) (together poster and abstract—13 pages).
Bookbinder et al., "Enhancing drug transport through temporary matrix depolymerization," Keystone Symposia 2005, Abstract, 1 page.
Bookbinder et al., "Evaluation of the compatibility and pharmacokinetics of co-formulated biologics with recombinant human hyaluronidase: Dose Response," American Association of Pharmaceutical Scientists Conference, Nov. 2006. Abstract, 2 pages.
PinIcstaff et al., "Evaluation of the compatibility and pharmacokinetics of co-formulated biologics with recombinant human hyaluronidase: Dose Response," American Association of Pharmaceutical Scientists Conference, Nov. 2006. Poster, 1 page.
Byerley et al., "'Cutting out the bull'. Recombinant human hyaluronidase: Moving to an animal-free system," Association of Clinical Embryologists, 2006, Dublin, Ireland. Abstract published in Human Fertility, 9(2):110 (2006).
Frost et al., "Punctuated equilibrium: The evolution of recombinant human hyaluronidase," Ophthalmic Anesthesia Society, 2006, Chicago, IL, abstract, 1 page.
Frost et al., "Punctuated equilibrium: The evolution of recombinant human hyaluronidase," Ophthalmic Anesthesia Society, 2006, Chicago, IL, presentation, 35 pages.
Haller et al., "Enhanze technology—a revolution in drug dispersion," Biotechnology Industry Organization (BIO) Annual Meeting, Jun. 19-22, 2005, Philadelphia, PA. Abstract, 3 pages.
Haller et al., "Recombinant human hyaluronidase for the interstitial transport of therapeutics," American Association of Pharmaceutical Scientists Conference, Jun. 2006, San Antonio, TX, Abstract, 2 pages.
Haller et al., "Recombinant human hyaluronidase for the interstitial transport of therapeutics," Controlled Release Society Conference, Vienna, Austria, 2006, Abstract, 2 pages.
Haller et al., "Revolutionizing drug dispersion with enhanze technology," American Association of Pharmaceutical Scientists Annual Meeting, Nov 6-10, 2005, Nashville, TN, Poster 1 page.
Haller et al., "Revolutionizing drug dispersion with enhanze technology," Biotechnology Industry Organization (BIO) Annual Meeting, Jun. 19-22, 2005, Philadelphia, PA. Poster, 1 page.
Haller et al., "The effects of recombinant human hyaluronidase on drug dispersion," American Association of Pharmaceutical Scientists Annual Meeting, Abstract in AAPS Journal 7(S2) May 5, 2005; 3 pages.
Haller, "Enhanze technology—an enzymatic drug delivery system (DDS)," Japanese Export Trade Organization, Nov. 2005, Santa Clara, CA. Abstract, 2 pages.
Haller, M., "Focus on enhanced and innovative recombinant human enzymes," Japanese Export Trade Organization, Sep. 2004, Chicago, IL., Presentation, 16 pages.
Haller, M., "Halozyme's enhanze technology for the enhanced dispersion of co-injected pharmaceuticals," Japanese Export Trade Organization, Sep. 2004, Chicago, IL, Abstract, 2 pages.
Haller, M., "Enzyme-facilitated parenteral drug transport," Strategic Research Institute's 10th Anniversary Drug Delivery Technology and Deal-making Summit 2005, New Brunswick, NJ. Presentation, 24 pages.
Hofer et al., "Human recombinant hyaluronidase increases the convection of molecules up to 0.2 µm in athymic nude mice," American Association for Laboratory Animal Science, 2006, Salt Lake City, UT. Abstract published in J. Am. Assoc. Lab. Animal Sci., 45:120, Abstract P97 (2006), 1 page.
Hofer et al., "Human Recombinant Hyaluronidase Increases the Convection of Molecules up to 0.2 µm in Athymic Nude Mice," American Association for Laboratory Animal Science, 2006, Salt Lake City, UT. Poster published in J. Am. Assoc. Lab. Animal Sci., 45:120, Poster P97 (2006), 1 page.
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Abstract, 1 page.
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Poster, 1 page.
Kodandapani et al., "Diverse structural and functional roles of N-glycosylations on rHuPH20," Glycan Abstract, 1 page (2009).
Nadjsombati et al., "Evaluation of developmental and prenatal/postnataal reproduction toxixity of rHuPH20 in mice," American College of Toxicology 30th annual meeting, Nov. 1-4, 2009, Palm Springs, CA, Abstract, 1 page.
Nagy et al., "Prospective, randomized study on bovine and recombinant human (Cumulase®) Hyaluronidases," American Society of Reproductive Medicine, 2006, New Orleans, LA, 06-A-886-ASRM, 2 pages.

(56) References Cited

OTHER PUBLICATIONS

Nagy, Z., "Prospective study on rHuPH20," European Society of Human Reproduction & Embryology Annual Meeting, Jun. 19-22, 2005, Copenhagen, Denmark. Abstract O-213, 1 page.
Pinkstaff et al., "Recombinant human hyaluronidase for drug and fluid dispersion," American Association of Pharmaceutical Scientists Annual Meeting, Nov. 2006, Boston, MA, Abstract, 2 pages.
Pinkstaff et al., "Recombinant human hyaluronidase for drug and fluid dispersion," American Association of Pharmaceutical Scientists Annual Meeting, Nov. 2006, Boston, MA, Poster, 1 page.
Wei et al., "Functions of N-linked glycans on human hyaluronidase PH20," presented at San Diego Glycobiology Symposium 2009. Poster 83, 1 page.
Wei et al., "Structure function analysis of the human hyaluronidase enzymes," Matrix Biology 27 (Supplement 1):S41, Dec. 2008, American Society for Matrix Biology Biennial Meeting, San Diego, CA, (available on-line Nov. 17, 2008), Abstract 132, 1 page.
Wei et al., "Structure function analysis of the human hyaluronidase enzymes," Presented at American Society for Matrix Biology Biennial Meeting, San Diego, CA, Dec. 9, 2008, Poster B4, 1 page.
Wilson, M., "Enhanze technology—an enzymatic drug delivery system (DDS)," Japanese Export Trade Organization, Nov. 2005, Santa Clara, CA. Oral presentation, 22 pages.
Letter/Written Disclosure of the Supplemental Information Disclosure Statement for the above-referenced application, filed herewith Apr. 20, 2016, 2 pages.
Derwent English abstract for Japanese Publication No. JP 2007-153797, published Jun. 21, 2007, entitled "Therapeutic Agent and Preventive Agent of Autoimmune Disease, Inflammation, and Nervous Disease," 3 pages.
Eskens et al., "Enzymatic glycocalyx treatment impairs insulin-mediated recruitment of microvascular blood volume and decreases insulin sensitivity in rats," FASEB Journal 25: 1023.13 (2011) (Abstract).
M3WD76 Felca (2015, updated) Hyaluronidase/PH20 from Felis catus, 3 pages.
Wells et al., "Additivity of Mutational Effects in Proteins" Biochem 29: 8509-8517 (1990).
News Release, Halozyme Therapeutics, Inc., "Halozyme to Present Data from Five Preclinical Studies at American Association of Cancer Research Annual Conference," Published Mar. 17, 2016 [online], Retrieved from: <halozyme.com/investors/news-releases/news-release-details/2016/Halozyme-To-Present-Data-From-Five-Preclinical-Studies-At-American-Association-Of-Cancer-Research-Annual-Conference/defaultaspx [retrieved on Mar. 28, 2016], 5 pages.
Examiner's Report, issued Mar. 1, 2016, in connection with Canadian Patent Application No. 2861919, 7 pages.
Response, filed Oct. 9, 2015, to Office Action, issued May 25, 2015, in connection with Chinese Patent Application No. 201280070954.9 [English instructions and document as filed in Chinese], 37 pages.
Official Action, issued Jan. 19, 2016, in connection with Japanese Patent Application No. 2014-550526 [English translation and original document in Japanese], 8 pages.
Search Report and Written Opinion, dated Dec. 4, 2015, in connection with Singaporean Patent Application No. 11201403714T, 7 pages.
Office Action, issued Feb. 3, 2016, in connection with Chinese Patent Application No. 201280070954.9 [English language translation and original document in Chinese], 6 pages.

\* cited by examiner

FIGURE 1

LNFRAPPVIPNVPFLWAWNAPSEFCLGKFDEPLDMSLFSFIGSPRINATGQCVTIFYVDR 60

LGYYPYIDSTTGVTVNGGIPQKTSLQDHLDKAKKDITFYMPVDNLGMAVIDWEEWRPTWA 120

RNWKPKDVYKNRSIELVQQNVQLSLTEATEKAKQEFEKAGKDFLVETIKLGKLLRPNHL 180

WGYYLFPDCYNHHYKKPGYNGSCENVEIKRNDDLSWLWNESTALYPSIYLNTQQSPVAAT 240

LYVRNRVREAIRVSKIPDAKSPLPVFAYTRIVFTDQVLKFLSQDELVYTFGETVALGASG 300

IVIWGTLSIMRSMKSCLLLDNYMETILNPYIINVTLAAKMCSQVLCQEQGVCIRKNWNSS 360

DYLHLNPDNFAIQLEKGGKFTVRGKPTLEDLEQFSEKFYCSCYSTLSCKEKADVKDTDAV 420

DVCIADGVCIDAFLKPPMETEEPQIFYNASPSTLSATMFIVSILFLIISSVASL 474

FIGURE 2A

```
SEQIDNO_3         LNFRAPPVIPNVPFLWAWNAPSEFCLGKFDEPLDMSLFSFIGSPRINATGQGVTIFYVDR  60
chimp_SEQIDNO_10  LNFRAPPVIPNVPFLWAWNAPSEFCLGKFDEPLDMSLFSFIGSPRINVTGQDVTIFYVDR  60
                  ***********************************************.***.*****:**

SEQIDNO_3         LGYYPYIDSITGVTVNGGIPQKISLQDHLDKAKKDITFYMPVDNLGMAVIDWEEWRPTWA  120
chimp_SEQIDNO_10  LGYYPYIDSITGVTVNGGIPQKISLQDHLDKAKKDITFYMPVDNLGMAVIDWEEWRPTWA  120
                  ************************************************************

SEQIDNO_3         RNWKPKDVYKNRSIELVQQQNVQLSLTEATEKAKQEFEKAGKDFLVETIKLGKLLRPNHL  180
chimp_SEQIDNO_10  RNWKPKDVYKNRSIELVQQQNVQLSLTEATEKAKQEFEKAGKDFLVETIKLGKLLRPNHL  180
                  ************************************************************

SEQIDNO_3         WGYYLFPDCYNHYKKPGYNGSCENVEIKRNDDLSWLWNESTALYPSIYLNTQQSPVAAT  240
chimp_SEQIDNO_10  WGYYLFPDCYNHYKKPGYNGSCENVEIKRNDDLSWLWNESTALYPSIYLNTQQSPVAAT  240
                  ************************************************************

SEQIDNO_3         LYVRNRVREAIRVSKIPDAKSPLPVFAYTRIVFTDQLKFLSQDELVYTFGETVALGASG  300
chimp_SEQIDNO_10  LYVRNRVQEAIRVSKIPDAKSPLPVFVYTRIVFTDQLKFLSQDELVYTFGETVALGASG  300
                  *******:******************:*****:***************************

SEQIDNO_3         IVIWGTLSIMRSMKSCLLLDNYMETILNPYIINVTLAAKMCSQVLCEQGVCIRKNWNSS  360
chimp_SEQIDNO_10  IVIWGTLSIMRSMKSCLLLDNYMETILNPYIINVTLAAKMCSQVLCEQGVCIRKNWNSS  360
                  ************************************************************

SEQIDNO_3         DYLHLNPDNFAIQLEKGGKFTVRGKPTLEDLEQFSEKFYCSCYSTLSCKEKADVKDTDAV  420
chimp_SEQIDNO_10  DYLHLNPDNFAIQLEKGGKFTVRGKPTLEDLEQFSEKFYCSCYSTLSCKEKADVKDTDAV  420
                  ************************************************************

SEQIDNO_3         DVCIADGVCIDAFLKPPMETEEPQIFY-------------------------  447
chimp_SEQIDNO_10  DVCIADGVCIDAFLKPPMETEESQIFYNASPSTLSATMFIVSILFLIISSVASL  474
                  **********************.****
```

FIGURE 2B

```
SEQIDNO_3         LNFRAPPVIPNVPFLWAWNAPSEFCLGKFDEPLDMSLFSFIGSPRINATGQGVTIFYVDR   60
Rhesus_SEQIDNO_12 LNFRAPPIIPNVPFLWAWNAPSEFCLGKFNEPLDMSLFTLMGSPRINITGQGVTIFYVDR   60
                  ******* *******************.***********::****** ***********

SEQIDNO_3         LGYYPYIDSITGVTVNGGIPQKHSLQDHLDKAKKDITFYMPVDNLGMAVIDWEEWRPTWA  120
Rhesus_SEQIDNO_12 LGYYPYIDETTGVTVHGGIPQKVSLQDHLDKSKQDILFYMPVDNLGMAVIDWEEWRPTWA  120
                  ********  *****:****** ********:*:**:***********************

SEQIDNO_3         RNWKPKDVYKNRSIELVQQQNVQLSLTEATEKAKQEFEKAGKDFLVETIKLGKLLRPNHL  180
Rhesus_SEQIDNO_12 RNWKPKDVYKNRSIELVQQQNVQLSLPQATDKAKQEFEKAGKDFMLETIKIKLGRSLRPNHL  180
                  **************************  **:*********** :*****:** ******

SEQIDNO_3         WGYYLFPDCYNHYKKPGYNGSCENVEIKRNDDLSWLWNESTALYPSIYLNTQQSPVAAT  240
Rhesus_SEQIDNO_12 WGYYLFPDCYNHYRKPGYNGSCEDVEIKRNDDLSWLWNESTALYPSIYLNTQQSVVVAT  240
                  *************:********:*********************.*:* *

SEQIDNO_3         LYVRNRVREAIRVSKIPDAKSPLPVFAYTRHVFTDQLKFLSQDELVYTFGETVALGASG  300
Rhesus_SEQIDNO_12 LYVRNRVREAIRVSKIPDAKNPLPVFVYARLVFTDQLKFLSREELVSTLGETVALGASG  300
                  ********************.*****.**:******* :***   ************

SEQIDNO_3         IVIWGTLSIMRSMKSCLLLDNYMETILNPYIINVTLAAKMCSQVLCEQGVCIRKNWNSS  360
Rhesus_SEQIDNO_12 IVIWGSLSITRSMKSCLLLDTYMETILNPYIINVTLAAKMCSQVLCEQGVCIRKDWNSS  360
                  *****:***:**********.*************************:*****:****

SEQIDNO_3         DYLHLNPDNFAIQLEKGGKFTVRGKPTLEDLEQFSEKFYCSCYSTLSCKEKADVKDTDAV  420
Rhesus_SEQIDNO_12 DYLHLNPDNFDIRLEKGGKFTVHGKPTVEDLEEFSEKFYCSCYTNLSCKEKADVKDTDAV  420
                  ********** *:********:****.****:*********:.****************

SEQIDNO_3         DVCIADGVCIDAFLKPPMETE-EPQIFY------------------------  447
Rhesus_SEQIDNO_12 DVCIADGVCIDASLKPPVETEGSPPIFYNTSSSTVSTTMFIWRLEVWDQGISRIGFF  477
                  ************ ****:***  * ***
```

FIGURE 2C

```
SEQIDNO_3         LNFRAPPVIPNVPFLWAWNAPSEFCLGKFDEPLDMSLFSFIGSPRINATGQGVTIFYVDR    60
Cyno_SEQIDNO_14   LNFRAPPIIPNVPFLWAWNAPSEFCLGKFNEPLDMSLFTLMGSPRINVTGQGVTIFYVDR    60
                  *******:******************** :********::*.*****.****:*******

SEQIDNO_3         LGYYPYIDSHTGVTVNGGIPQKHSLQDHLDKAKKDITFYMPVDNLGMAVIDWEEWRPTWA    120
Cyno_SEQIDNO_14   LGYYPYIDEHTGVTVHGGIPQKVSLQDHLDKSKQDILFYMPVDNLGMAVIDWEEWRPTWA    120
                  ********.******:******.********:*:**:***********************

SEQIDNO_3         RNWKPKDVYKNRSIELVQQQNVQLSLTEATEKAKQEFEKAGKDFLVETIKLGKLLRPNHL    180
Cyno_SEQIDNO_14   RNWKPKDVYKNRSIELVQQQNVQLSLPQATDKAKQEFEKAGKDFMLETIKLGRSLRPNHL    180
                  **************************  **:************:*******:. *****

SEQIDNO_3         WGYYLFPDCYNHYKKPGYNGSCHNVEIKRNDDLSWLWNESTALYPSIYLNTQQSPVAAT    240
Cyno_SEQIDNO_14   WGYYLFPDCYNHYRKPGYNGSCEDVEIKRNDDLSWLWNESTALYPSIYLNTQQSVVVAT    240
                  *************:********.:******************************.*.**

SEQIDNO_3         LYVRNRVREAIRVSKIPDAKSPLPVFAYTRMVFTDQVLKFLSQDELVYTFGETVALGASG    300
Cyno_SEQIDNO_14   LYVRNRVREAIRVSKIPDAKNPLPVFMYARIVFTDQVLKFLSREELVSTLGETVALGASG    300
                  ********************.*****  ** *********: :***.*:**********

SEQIDNO_3         IVIWGTLSIMRSMKSCLLLDNYMETILNPYIINVTLAAKMCSQVLCQEQGVCIRKNWNSS    360
Cyno_SEQIDNO_14   IVIWGSLSITRSMKSCLLLDTYMETILNPYIINVTLAAKMCSQVLCQEQGVCIRKDWNSS    360
                  *****:***:**********.*********************************:****

SEQIDNO_3         DYLHLNPDNFAIQLEKGGKFTVRGKPTLEDLEQFSEKFYCSCYSTLSCKEKADVKDTDAV    420
Cyno_SEQIDNO_14   DYLHLNPDNFDIRLEKGGKFTVHGKPTVEDLEEFSEKFYCSCYTNLSCKEKADVKDTDAV    420
                  **********  :********:****:****:**********:.****************

SEQIDNO_3         DVCIADGVCIDAFLKPPMETE-EPQIFY-----------------------    447
Cyno_SEQIDNO_14   DVCIADGVCIDASLKPPVETEGSPPIFYNTSSSTVSSTMFIVNLFLIISSVASL    475
                  ************ ****:*** .* :***
```

FIGURE 2D

```
SEQIDNO_3          LNFRAPPVIPNVPFLWAWNAPSEFCLG-KFDEPLDMSLFSFIGSPRINATGQGVTIFYVD   59
bovine_SEQIDNO_16  LDFRAPPLISNTSFLWAWNAPVERCVNRRFQLPPDLRLFSVKGSPQKSATGQEITLFYAD   60
                   *:******:*.*:****** *.*  *: .::*  *: **** :  ****.*: ****:*

SEQIDNO_3          RLGYYPYIDSITGVTVNGGIPQKTSLQDHLDKAKKDITFYMPVDNLGMAVIDWEEWRPTW  119
bovine_SEQIDNO_16  RLGYYPHIDEKTGKTVFGGIPQLGNLKSHMEKAKNDIAYYIPNDSVGLAVIDWENWRPTW  120
                   ******:**. **:**.***** .:*:.::*:***.**::*:*:*.*******:*****

SEQIDNO_3          ARNWKPKDVYKNRSIELVQQQNVQLSLTEATEKAKQEFEKAGKDFLVETIKLGKLLRPNH  179
bovine_SEQIDNO_16  ARNWKPKDVYRDESVELVLQKNPQLSFPEASKIAKVDFETAGKSFMQETLKLGKLLRPNH  180
                   **********::.*:***  :* ***: ***:.**.:**.***.*::**:*********

SEQIDNO_3          LWGYYLFPDCYNHHYKKPGYNGSCENVEIKRNDDLSWLWNESTALYPSIYLNT-QQSPVA  238
bovine_SEQIDNO_16  LWGYYLFPDCYNHNHNQPTYNGNCEDVEKRRNDDLEWLWKESTALFPSVYLNIRLKSTQN  240
                   *************::::* ***.**:**::**** ***:*****:**:***   :*..

SEQIDNO_3          ATLYVRNREAIRVSKIPDAKSPLPVFAYTRIVFTDQVLKFLSQDELVYTFGETVALGA    298
bovine_SEQIDNO_16  AALYVRNRVQEAIRLSKIASVESPLPVFWYARPVFTDGSTYLSQGDLVNSVGEIVSLGA    300
                   *:****** :****.***..:.******  *   ****.   ***.*** :.**:****

SEQIDNO_3          SGIVIWGTLSIMRSMKSCLLLDNYMETILNPYIINVTLAAKMCSQVLCEQGVCIRKNWN    358
bovine_SEQIDNO_16  SGIIMWGSLNLSLSMQSCMNLGTYLNTTLNPYIINVTLAAKMCSQVLCHNEGVCTRKHWN    360
                   ***::**:*.:: **:**:   * :*:******************..:*.:***:***

SEQIDNO_3          SSDYLHLNPDNFAIQLEKGGKFTVRGKPTLEDLEQFSEKFYCSCYSTLSCKEKADVKDTD  418
bovine_SEQIDNO_16  SSDYLHLNPMNFAIQTGEGGKYTVPGTVTLEDLQKFSDTFYCSCYANIHCKKRVDIKNVH  420
                   ********* *****  ****:** * .*****::**: *****.*:.***::.*:*: :

SEQIDNO_3          AVDVCIADGVCIDAFLKP------------------------------------------  436
bovine_SEQIDNO_16  SVNVCMAEDICIDSPVKLQPSDHSSSQEASTTFSSISPSTTATVSPCTPEKHSPECLK    480
                    *:.**:*. ***: :*

SEQIDNO_3          -------------------PMETEEPQIFY                                447
bovine_SEQIDNO_16  VRCSEVIPNVTQKACQSVKLKNISYQSPIQNIKNQTTY                        518
                                      *::. : **  *
```

FIGURE 2E

```
SEQIDNO_3        LNFRAPPVIPNVPFLWAWNAPSEFCLGKFDEPLDMSLFSFIGSPRINATGQGVTIFYMDR    60
Mouse_SEQIDNO_20 VDYRAAPILSNTTFLWIWNVPTERCVGNVNDPIDLSFFSLIGSPRKTATGQBVTLFYMDR    60
                 ::.:**..*..*.****.**:.**.*..*:**:.******:****** **:****:**

SEQIDNO_3        LGYYPYIDSITGVTVNGGIPQKMSLQDHLDKAKKDITFYMPVDNLGMAVIDWEEWRPTWA   120
Mouse_SEQIDNO_20 LGLYPHIDANQAEHY-GGIPQRGDYQAHLRKAKTDIEHYIPDDKLGLAIIDWEEWRPTWL   119
                 **.**:**:*. *:: ****:  :**:*.***.**.:*:*:*::*:*:****

SEQIDNO_3        RNWKPKDVYKNRSIELVQQQNVQLSLTEATEKAKQEFEKAGKDFLVETIKLGKLLRPNHL   180
Mouse_SEQIDNO_20 RNWKPKDNYRNKSIELVQSTNPGLSITEATQKAIQQFEEAGRKFMEGTLHLGKFLRPNQL   179
                 *******.*:*:***** ** ***:****:** **:**:**:*:: * :***:****:

SEQIDNO_3        WGYYLFPDCYNHHYKKPGYNGSCFNVEIKRNDDLSWLWNESTALYPSIYLNTQQ-SPVAA   239
Mouse_SEQIDNO_20 WGYYLFPDCYNNKFQDPKYDGQCPAVEKKRNDNLKWLWKASTGLYPSVYLKKDLKSNRQA   239
                 *********:.. . :****.* .** ****:*.***: **.****:**:. * *:*

SEQIDNO_3        TLYVRNRVREAIRVSKIPDAKSPLPVFAYTRIVFTDQVLKFLSQDELVYTFGETVALGAS   299
Mouse_SEQIDNO_20 TLYVRYRVVEAIRVSKVGNASDPVPIFMYIRFVFTDRLSEYLLEDDLVNTIGEIVALGTS   299
                 ***** ** *******:.:*. **:* *.*:*****:: :.*.:*:**.*:**.****:*

SEQIDNO_3        GIVIWGTLSIMRSMKSCLLLDNYMETILNPYIINVTLAAKMCSQVLCQEQGVCIRKNWNS   359
Mouse_SEQIDNO_20 GIIIWDAMSLAQRAAGCPILHKYMQTTLNPYIVNVTLAAKMCSQTLCNEKGMCSRRKESS   359
                 **:**.: *::*:: .* :*:.**:*.*****:***********.**:*:*:*.::* *

SEQIDNO_3        SDYLHLNPDNFAIQLEKGGKFTVRGKPTLEDLEQFSEKFYCSCYSTLSCKEKADVKDTDA   419
Mouse_SEQIDNO_20 DVYLHLNPSHFDIMLTETGKYEVLGNPRVGDLEYFSEHFKCCSCFSRMTCKETSDVKNVQD   419
                 . *******..* *: ..**:.* *:*.:**::***:*.*.**:*..*****:.***:.

SEQIDNO_3        VDVCIADGVCIDAFLKPP----------METEEPQIFY-------------   447
Mouse_SEQIDNO_20 VNVCVGDNVCIKAKVEPNPAFYLLPGKSLLFMTTLGHVLYHLPQDIFVFPRKTLVSTP   477
                 *:**:.*.*** *.::**           :*   : ::*
```

FIGURE 2F

```
SEQIDNO_3         LNFRAPPVIPNVPFLWAWNAPSEFCLGKFDEPLDMSLFSFIGSPRINATGQGVTIFYMDR  60
Rat_SEQIDNO_22    VDYRATPVLSDTTFVWVWNVPTEACVENVTEPIDLSFFSLIGSPRKTAIGQPVTLFYMDR  60
                  .:::.**..**..::.**.:**.*.:.  **:::**.******:****:. :*:**:**

SEQIDNO_3         LGYYPYIDSITGVTVNGGIPQKTSLQDHLDKAKKDITFYMPVDNLGMAVIDWEEWRPTWA  120
Rat_SEQIDNO_22    LGNYPHIDAQQ-TEHHGGIPQKGDLTTHLVKAKEDVERYIPTDKLGLAIIDWEEWRPTWM  119
                  **.***.*: :  *.:****** .*..**..***:.. :*.*:**:*::*********

SEQIDNO_3         RNWKPKDVYKNRSIELVQQQNVQLSLTEATEKAKQEFEKAGKDFLVETIKLGKLLRPNHL  180
Rat_SEQIDNO_22    RNWTPKDIYRNKSIELVQAADPAINITEATVRAKAQFEGAAKEFMEGTLKLGKHIRPKHL  179
                  ***.***:*:*:******.  :.: :****.:***:** *.*:*: *:****::**::*

SEQIDNO_3         WGYYLFPDCYNHHYKKPGYNGSCENVEIKRNDDLSWLWNESTALYPSIYLNTQQ-SPVAA  239
Rat_SEQIDNO_22    WGFYLFPDCYNNKFQVDNYDGQCPDVEKKRNDDLDWLWKESTGLYPSVYLKKDLKSSRKA  239
                  **:********:::: .:*:*.*..**:*****.***:*** ****:**:.:  .*..*

SEQIDNO_3         TLYVRNRVREAIRVSKIPDAKSPLPVFAYTRFVFTDQVLKFLSQDELVYTFGETVALGAS  299
Rat_SEQIDNO_22    TLYVRYRVLESIRVSKVSDESNPVPIFMYIRLVFTDHVSEYLLEDDLVNTIGEIVAQGTS  299
                  ***** ** *:*****:.*:..*:*:* * *:****:*  :* :*:**.*:**:** .:*

SEQIDNO_3         GIVIWGTLSIMRSMKSCLLLDNYMETILNPYIINVTLAAKMCSQVLCEQGVCIRKNWNS  359
Rat_SEQIDNO_22    GIIIWDAMSLAQRSAGCPILRQYMKTTLNPYIVNVTLAAKMCSQTLCKEKGMCSRKTESS  359
                  **:**  :*:::.*..* :*:.**:* *****:***********.**::*:**:*  **

SEQIDNO_3         SDYLHLNPDNFAIQLEKGGKFTVRGKPTLEDLEQFSEKFYCSCYSTLSCKEKADVKDTDR  419
Rat_SEQIDNO_22    DAYLHLDPSSFSINVTEAGKYEVLGKPEVKDLEYFSEHFKCSCFSKMTCEETSDMRSIQD  419
                  .:****:*..*:*::.:.**: * *** ::**:***:* ***:*.::*:*:.*::..:

SEQIDNO_3         VDVCIADGVCIDAFLKPP------------METEEPQIFY-------------  447
Rat_SEQIDNO_22    VNVCMGDNVCIKATLGPNSAFHLLPGKGLLMTTLAHILHHLPHDIFVFPWKMLVSTP  477
                  *:** .*.***.*:*.*        : :*   .::.:.
```

FIGURE 2G

```
SEQIDNO_3         LNFRAPPVIPNVPFLWAWNAPSEFCLGKFDEPLDMSLFSFIGSPRINATGQGVTIFYMDR 60
Rabbit_SEQIDNO_24 ANFRAPPVIPNVPFLWAWNAPTEFCLGKSGEPLDMSLFSLFGSPRKNKTGQGITIFYMDR 60
                  :********************:*****. *********** *******:*:*****:***

SEQIDNO_3         LGYYPYIDSITGVTVNGGIPQKHSLQDHLDKAKKDITFYMPVDNLGMAVIDWEEWRPTWA 120
Rabbit_SEQIDNO_24 LGYYPYIDPHTGAIVHGRIPQLGPLQQHLTKLRQEILYYMPKDNVGLAVIDWEEWLPTWL 120
                  ********  **.*  * ***  .***.*: ::* :*** *:::::*********:***

SEQIDNO_3         RNWKPKDVYKNRSIELVQQQNVQLSLTEATEKAKQEFEKAGKDFLVETIKLGKLLRPNHL 180
Rabbit_SEQIDNO_24 RNWKPKDIYRIKSIELVKSQHPQYNHSYATEKAKRDFEKAGKDFMEETLKLGRLLRPNHL 180
                  *******:*: :*****  *:.* :: :******::********::** :***:******

SEQIDNO_3         WGYYLFPDCYNHHYKKP-GYNGSCFNVEIKRNDDLSWLWNESTALYPSIYLNTQQ---SP 236
Rabbit_SEQIDNO_24 WGYYLFPDCYNHHYDKPNLYKGSCEDIEKKRNDDLSWLWKESTALFPSVYLTSRARSATA 240
                  **************.** ::*** :: :*********:****:**:**.:::      :

SEQIDNO_3         VAATLYVRNRVREAIRVSKIPDAKSPLPVFAYTRIVFTDQVLKFLSQDELVYTFGETVAL 296
Rabbit_SEQIDNO_24 LSKLYVVRNRVHEAIRVSKIPDDKSPLPNFVYTRMVFTDQIFQFLSHHDLVYTIGEIVAL 300
                  :: ****:*** *********:***** *.***:*****:::***.::*****:**:***

SEQIDNO_3         GASGIVIWGTLSIMRSMKSCLLLDNYMETILNPYIINVTLAAKMCSQVLCEEQGVCIRKN 356
Rabbit_SEQIDNO_24 GASGIVVWGSQSLARSMKSCLHLDNYMKTILNPYLINVTLAAKMCNQVLCEEQGVCTRKN 360
                  ******:**: *:.:******  ****** *******:***********:****** ***

SEQIDNO_3         WNSSDYLHLNPDNFAIQLEKGGKFTVRGKPTLEDLEQFSEKFYCSCYSTLSCKEKADVKD 416
Rabbit_SEQIDNO_24 WNPNDYLHLNPGNFAIQLGSNGTYKVDGKPTLEDLEQFSKNFQCSCYTNLNCKERTDMNN 420
                  **..*******.*****  .*  ::* .*******:*******:.*:******.:::

SEQIDNO_3         TDAVDVCIADGVCIDAFLKPPMETEEPQ--------------------------- 444
Rabbit_SEQIDNO_24 VREINVCAVENVCIDTNVGPQAVTYAPKEKKDVAHILSNTTSINSSTTMSLPFPRKHVSG 480
                  .:: **: ::.*** *  :::: .* :   *

SEQIDNO_3         -----------IFY------- 447
Rabbit_SEQIDNO_24 CLLVLCMYSQYLNICYRLVAIGIQHGYYLK 510
                              *  *
```

FIGURE 2H

```
SEQIDNO_3              LNFRAPPVIPNVPFLWAWNAPSEFCLGKFDEPLDMSLFSFIGSPRINATG  50
GuineaPig_SEQIDNO_29   -DKRAPPLIPNVPLLWVWNAPTEFCIGGTNQPLDMSFFSIVGTPRKNITG  49
                        :***********:*******:**:*  ::******::**:**:*:.**

SEQIDNO_3              QGVTIFYVDRLGYYPYIDSTTGVTVNGGIPQKTSLQDHLDKAKKDITFYM 100
GuineaPig_SEQIDNO_29   QSITLYYVDRLGYYPYIDPHTGAIVHGGLPQLMNLQQHLRKSRQDILFYM  99
                       *.:*:****:******* .** .*.*.*.*.*.:.*:**:*::** .**:***

SEQIDNO_3              PVDNLGMAVIDWEEWRPTWARNWKPKDVYKNRSIELVQQONVQLSLTEAT 150
GuineaPig_SEQIDNO_29   PTDSVGLAVIDWEEWRPTWTRNWRPKDIYRNKSIELVKSQHPQYNHSYAV 149
                       *.*.:* ***********:***:***:*:*:****:.*: .* *:* *.

SEQIDNO_3              EKAKQEFEKAGKDFLVETIKLGKLLRPNHLWGYYLFPDCYNHHYKKPGYN 200
GuineaPig_SEQIDNO_29   AVAKRDFERTGKAFMLETLKLGKSLRPSSLWGYYLFPDCYNTHFTKPNYD 199
                        .**::** :**.*::***:****.***...*********** *:.**  .

SEQIDNO_3              GSCENVEIKRNDDLSWLWNESTALYPSIYLNTQQ-SPVAATLYVRNRVRE 249
GuineaPig_SEQIDNO_29   GHCPPIELQRNNDLQWLWNDSTALYPSVYLTSRVRSSQNGALYVRNRVHE 249
                       *.*  :*::**:**.***::*******:**.:: ..  . .*******:*

SEQIDNO_3              AIRVSKIPDAKSPLPVFAYTRIVFTDQVLKFLSQDELVYTFGETVALGAS 299
GuineaPig_SEQIDNO_29   SIRVSKLMDDKNPLPIYVIRIVFTDQTTFLELDDLVHSVGEIVPLGVS 299
                       :*****: *.*.***:: * *:***** ::*  * *:* .** * **.*

SEQIDNO_3              GIVIWGTLSIMRSMKSCLLLDNYMETILNPYIINVTLAAKMCSQVLCQEQ 349
GuineaPig_SEQIDNO_29   GIIIWGSLSLTRSLVSCIGLENYMKGTLLPYLINVTLAAKMCGQVLCKNQ 349
                       **:***:**: **: **  *:***: **:**:***********.****::*

SEQIDNO_3              GVCIRKNWNSSDYLHLNPDNFAIQLEKGGKFTVRGKPTLEDLEQFSEKFY 399
GuineaPig_SEQIDNO_29   GICTRKDWNTNTYLHLNATNFDIELQQNGKFVVHGKPSLEDLQEFSKNFH 399
                       *:* **:**.. ******.:** *: :.***.*.***:****::**::*:

SEQIDNO_3              CSCYSTLSCKEKADVKDTDAVDVCIADGVCIDAFL-------KPPMET 440
GuineaPig_SEQIDNO_29   CSCYTNVACKDRLDVHNVRSVNVCTANNICIDAVLNFPSLDDDDEPPITD 449
                       ****:.::**:: **:::. *:**.*: :*:***:*       :**:*

SEQIDNO_3              EEPQ-------------------------------IFY------ 447
GuineaPig_SEQIDNO_29   DTSQNQDSISDITSSAPPSSHILPKDLSWCLFLLSIFSQHWKYLL 494
                       : .*                               :*:
```

FIGURE 2I

```
SEQIDNO_3    LNFRAPPVIPNVPFLWAWNAPSEFCLGKFDEPLDMSLFSFIGSPRINATGQGVTIFYVDR    60
FOX          QEFRAPPFIPNVSFLWGWNAPTELCAKRFNVQLDLNLFSLIGSPLKTVVGQGIAIFYADR    60
                :****.****.****:******..*:..:**:   .:*: ***.******:  ..*** . ***

SEQIDNO_3    LGYYPYIDSITGVTVNGGIPQKISLQDHLDKAKKDITFYMPVDNLGMAVIDWEEWRPTWA    120
FOX          LGYYPHINKKTGKHVNGGIPQLGSLKKHLDKAKKDISHYIETDSMGLAVIDWDSWRPNWA    120
             ***** *: *: **:.*****   **:.******** ::*::*..:******:.***.**

SEQIDNO_3    RNWKPKDVYKNRSIELVQQNVQLSLTEATEKAKQEFEKAGKDFLVETIKLGKLLRPNHL    180
FOX          RNWRPKHIYKEQSIDLAQQQHIHLNLTEVTQIAQADFEKAARCFMQETLKLGKFLRPNYL    180
             ***:**.:**::**:*.**:: ** **.*: *::: ****.: *::** ****:****:*

SEQIDNO_3    WGYYLFPDCYNHHYKKPGYNGSCENVEIKRNDDLSWLWNESTALYPSIYLNTQQ-SPVAA    239
FOX          WGFYLYPDCYNYNYKNPNYNGSCMDIEERRNDEIDWLWKESTALFPSIYLKSKLKSSPFT    240
             **:**:*****::**:*.****  :::*:**::.***:*****:*****::. . *.

SEQIDNO_3    TLYVRNRVREAIRVSKIPDAKSPLPVFAYTRIVFTDQVLKFLSQDELVYTFGETVALGAS    299
FOX          ALYVRNRVLEAIRVSKVKDIKHPLPIFMVARDVFTDVLTYLTEDDLVNTIGESVSLGVS    300
             :*******  *******::* *::*:*.  * * ***.: ::: *:** *.***::**.

SEQIDNO_3    GIVIWGTLSIMRSMKSCLLLDNYMETILNPYIINVTLAAKMCSQVLCEQGVCIRKNWNS    359
FOX          GIVMWGSLNLTENVQICTELDTYIKNKLNPYIINVTLAAKMCSQVLCQDEGVCIRKHWNS    360
             ***:**:*.: .. ..   ::* ::.:******************:::*:****::***

SEQIDNO_3    SDYLHLNPDNFAIQLEKGGKFTVRGKPTLEDLEQFSEKFYCSCYSTLSCKEKADVKDTDA    419
FOX          NDYLHLNPVNFAIQLERSGRYTVQGKPTLEDLQQFSKKFYCACYANTHCRERVDMTDIHT    420
             .*******.*******:.*::**:*******::***:***:**:. *::* *.::**  :

SEQIDNO_3    VDVCIADGVCIDAFLKPP-------METEEPQIFY---------                447
FOX          IKVCVGEDVCIDVYLNLVPSGHLPVWKGKYVTSSNIFSVMPPATGPPCVPGRDLNRCLKA    480
             :.**:.:****. *: *         .  .. ***

SEQIDNO_3
FOX          RFIVEDNSKTTQTGYQSIYIKNKKQ    505
```

FIGURE 2J

```
SEQIDNO_3            LNFRAPPVIPNVPFLWAWNAPSEFCLGKFDEPLDMSLFSFIGSPRINATGQGVTIFYVDR 60
GIBBON_SEQIDNO_857   LNFRAPPVIPNVPFLWAWNAPSEFCLGKFDEPLDMSLFSLTGSPRINVTGQGVTIFYVDR 60
                     *********************************************:. **********.

SEQIDNO_3            LGYYPYIDSITGVTVNGGIPQKISLQDHLDKAKKDITFYMPVDNLGMAVIDWEEWRPTWA 120
GIBBON_SEQIDNO_857   LGYYPYIDSITGVTVNGGIPQKISLQDHLDKAKQDITFYMPVDNLGMAVIDWEEWRPTWA 120
                     *********************************:*************************

SEQIDNO_3            RNWKPKDVYKNRSIELVQQQNVQLSLTEATEKAKQEFEKAGKDFLVETIKLGKLLRPNHL 180
GIBBON_SEQIDNO_857   RNWKPKDVYKNRSIELVQQQNVQLSLAEATEKAKQEFEKAGKDFMVETIKLGKLLRPNHL 180
                     **************************:****************:***************

SEQIDNO_3            WGYYLFPDCYNHHYKKPGYNGSCENVEIKRNDDLSWLWNESTALYPSIYLNTQQSPVAAT 240
GIBBON_SEQIDNO_857   WGYYLFPDCYNHHYKKPGYNGSCENVEIKRNDDLSWLWNESTALYPSIYLNTQQSPVAAT 240
                     ************************************************************

SEQIDNO_3            LYVRNRVREAIRVSKIPDAKSPLPVFAYTRIVFTDQVLKFLSQDELVTFGETVALGASG 300
GIBBON_SEQIDNO_857   LYVRNRVREAIRVSKIPDAKSPLPVFVYARIVFTDQVYARIVFTDQVKFLSRDELVTLGETVALGASG 300
                     **************************.*: ****** .:.****.****************

SEQIDNO_3            IVIWGTLSIMRSMKSCLLLDNYMETILNPYIINVTLAAKMCSQVLCEQGVCIRKNWNSS 360
GIBBON_SEQIDNO_857   IVIWGSLSIVRSMKSCLLLDNYMETILNPYIINVTLAAKMCSQVLCEQGVCIRKDWNSS 360
                     *****:***:************************************:****.*****

SEQIDNO_3            DYLHLNPDNFAIQLEKGGKFTVRGKPTLEDLEQFSEKFYCSCYSTLSCKEKADVKDTDAV 420
GIBBON_SEQIDNO_857   DYLHLNPDNFAIQLEKGGKFTVRGKPTPEDLEQFSEKFYCSCYSTLSCKEKADVKDTDAV 420
                     ***************************:********************************

SEQIDNO_3            DVCIADGVCIDAFLKPPMETEEPQIFY---------------------- 447
GIBBON_SEQIDNO_857   DVCIADGVCIDAFLKPPKETEESQIFYNASPSTLSATMFIVSILFLIISSVVSL 474
                     *****************:****:****
```

FIGURE 2K

```
SEQIDNO_3             LNFRAPPVIPNVPFLWAWNAPSEFCLGKFDEPLDMSLFSFIGSPRINATGQGVTIFYVDR  60
MARMOSET_SEQIDNO_859  LNFRAPPIIPNVPFLWAWNAPSEFCLGKFDEPLDMSLFSLIGSPRINVTGQGVTIFYVDR  60
                      *******:*****************************:******.**************

SEQIDNO_3             LGYYPYIDSITGVTVNGGIPQKISLQDHLDKAKKDITFYMPVDNLGMAVIDWEEWRPTWA 120
MARMOSET_SEQIDNO_859  LGYYPYIDPTTGAVVNGGIPQKILALQDHLDKVRKDIIFYMPVDNLGMGVIDWEEWRPTWA 120
                      ******** .**.*********: :******.:**:***********.************

SEQIDNO_3             RNWKPKDVYKNRSIELVQQQNVQLSLTEATEKAKQEFEKAGKDFLVETIKLGKLLRPNHL 180
MARMOSET_SEQIDNO_859  RNWKPKDIYKNKSIEMVQQRNVQLNLTQATDIAKQEFEKAAKDFMLETIKLGKALRPNHL 180
                      *******:***:***:***:****.**.**::********.***::********.****

SEQIDNO_3             WGYYLFPDCYNHHYKKPGYNGSCENVEIKRNDDLSWLMNESTALYPSIYLNTQQSPVAAT 240
MARMOSET_SEQIDNO_859  WGYYLFPDCYNHHYKKPDYNGSCENIEIKRNNDLSWLMNESTALYPSIYLNTQQSAVAAM 240
                      *****************.*******:*****:**********************.***

SEQIDNO_3             LYVRNRVREAIRVSKIPDAKSPLPVFAYTRIVFTDQVLKFLSQDELVYTFGETVALGASG 300
MARMOSET_SEQIDNO_859  LYVRNRVQEAIRVSKTPNANSPLPVFVYARLVFTDQVLRFLSQDELVYTLGETVALGASG 300
                      *******:*******.*:*.******.*:*:******::*********:**********

SEQIDNO_3             IVIWGTLSIMRSMKSCLLLDNYMETILNPYIINVTLAAKMCSQVLCEQGVCIRKNWNSS 360
MARMOSET_SEQIDNO_859  IVIWGSLSIMRSMKSCLLLDTYMETVLNPYIINTTLLAAKMCSQVLCEQGVCIRKDWNSS 360
                      *****:**************.****:*******.**:*********************:****

SEQIDNO_3             DYLHLNPDNFAIQLEKGGKFTVRGKPTLEDLEQFSEKFYCSCYSTLSCKEKADVKDTDAV 420
MARMOSET_SEQIDNO_859  DYLHLNPDNFAIETEKGGKFTVRGKPTYEDLEQFSEKFYCSCYTSLSCKVKADVKDTDAV 420
                      ************ :**********************:***:*****:**.*********

SEQIDNO_3             DVCIADGVCIDAFLKPPMETEEP-QIFY-------------------------------447
MARMOSET_SEQIDNO_859  DVCIADGVCIDASLKPPKETEESSQIFYNPSSTPSAAIFIVAILFFISCVVSL       474
                      ************ ****  ****. ****
```

FIGURE 2L

```
SEQIDNO_3              LNFRAPPVIPNVPFLWAWNAPSEFCLGKFDEPLDMSLFSFIGSPRINATGQGVTIFYMDR  60
ORANGUTAN_SEQIDNO_861  LNFRAPPIIPNMPFLWAWNAPSEFCLGKFDEPLDMSLFSLIGSPRINVTGQAVTIFYMDR  60
                       *******:***:*********************:**********.***:******:***

SEQIDNO_3              LGYYPYIDSITGVTVNGGIPQKTSLQDHLDKAKKDITFYMPVDNLGMAVIDWEEWRPTWA  120
ORANGUTAN_SEQIDNO_861  LGYYPYIDSITGVTVNGGIPQKHSLQDHLDKAKKDILFYMPVDNLGMAVIDWEEWRPTWA  120
                       ********************** ************:***********************

SEQIDNO_3              RNWKPKDVYKNRSIELVQQQNVQLSLTEATEKAKQEFEKAGKDFLVETIKLGKLLRPNHL  180
ORANGUTAN_SEQIDNO_861  RNWKPKDVYKNRSIELVQQQNVQLNLTEATEKAKQEFEKAGKDFMVETIKLGKLLRPNHL  180
                       ************************.******************:***************

SEQIDNO_3              WGYYLFPDCYNHHYKKPGYNGSCFNVEIKRNDDLSWLWNESTALYPSIYLNTQQSPVAAT  240
ORANGUTAN_SEQIDNO_861  WGYYLFPDCYNHHYKKPGYNGSCFNVEIKRNDDLSWLWNESTALYPSIYLNTQQSPVAAT  240
                       ************************************************************

SEQIDNO_3              LYVRNRVREAIRVSKIPDAKSPLPVFAYTRHVFTDQVLKFLSQDELVYTFGETVALGASG  300
ORANGUTAN_SEQIDNO_861  LYVRNRVREAIRVSKIPDAKSPLPVFMYARIVFTDQVLKFLSQDELVYTFGETVALGASG  300
                       ************************** *:* ****************************

SEQIDNO_3              IVIWGTLSIMRSMKSCLLLDNYMETILNPYIINVTLAAKMCSQVLCQEQGVCIRKNWNSS  360
ORANGUTAN_SEQIDNO_861  IVIWGSLSIMRSMKSCLLLDNYMETILNPYIINVTLAAKMCSQVLCQEQGVCIRKDWNSS  360
                       *****:************************************************:****

SEQIDNO_3              DYLHLNPDNFAIQLEKGGKFTVRGKPTLEDLEQFSEKFYCSCYSTLSCKEKADVKDTDAV  420
ORANGUTAN_SEQIDNO_861  DYLHLNPDNFAIQLEKGGKFTVRGKPTLEDLEQFSEKFYCSCYSTLSCKEKADVKDTDAV  420
                       ************************************************************

SEQIDNO_3              DVCIADGVCIDAFLKPPMETEEPQIFY-------------------------  447
ORANGUTAN_SEQIDNO_861  DVCIADGVCIDAFLKPPMETEESQIFYNASPSTLSATMFIWRLEVWDQGISRMGFF  476
                       **********************:****
```

PH20 POLYPEPTIDE VARIANTS, FORMULATIONS AND USES THEREOF

RELATED APPLICATIONS

Benefit of priority is claimed to U.S. Provisional Application No. 61/631,313, filed Dec. 30, 2011, and to U.S. Provisional Application No. 61/796,208 filed Nov. 1, 2012, each entitled "PH20 Polypeptide Variants, Formulations and Uses Thereof."

This application is related to International PCT Application Serial No. PCT/US2012/072182, filed the same day herewith, entitled "PH20 Polypeptide Variants, Formulations and Uses Thereof," which claims priority to U.S. Provisional Application No. 61/631,313 and U.S. Provisional Application No. 61/796,208.

The subject matter of each of the above-noted related applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Dec. 28, 2012, is identical, 3.48 megabytes in size, and titled 3087seq.001.txt. A substitute Sequence Listing, incorporated by reference in its entirety, is provided on identical compact discs (labeled Copy 1 Replacement Mar. 20, 2013, Copy 2 Replacement Mar. 20, 2013). The computer-readable file on each of the aforementioned compact discs, created on Mar. 20, 2013, is identical, 3.50 megabytes in size, and titled 3087seq.002.txt. A substitute Sequence Listing, incorporated by reference in its entirety, is provided on identical compact discs (labeled Copy 1 Replacement Apr. 18, 2013, Copy 2 Replacement Apr. 18, 2013). The computer-readable file on each of the aforementioned compact discs, created on Apr. 18, 2013, is identical, 3.50 megabytes in size, and titled 3087seq.003.txt.

FIELD OF THE INVENTION

Modified PH20 hyaluronidase polypeptides, including modified polypeptides that exhibit increased stability and/or increased activity, are provided. Also provided are compositions and formulations and uses thereof.

BACKGROUND

Hyaluronan (hyaluronic acid; HA) is a polypeptide that is found in the extracellular matrix of many cells, especially in soft connective tissues. HA also is found predominantly in skin, cartilage, and in synovial fluid in mammals. Hyaluronan also is the main constituent of the vitreous of the eye. HA has a role in various physiological processes, such as in water and plasma protein homeostasis (Laurent T C et al. (1992) *FASEB J* 6:2397-2404). Certain diseases are associated with expression and/or production of hyaluronan. Hyaluronan-degrading enzymes, such as hyaluronidases, are enzymes that degrade hyaluronan. By catalyzing HA degradation, hyaluronan-degrading enzymes (e.g., hyaluronidases) can be used to treat diseases or disorders associated with accumulation of HA or other glycosaminoglycans. Also, since HA is a major component of the interstitial barrier, hyaluronan-degrading enzymes (e.g., hyaluronidase) increase tissue permeability and therefore can be used to increase the dispersion and delivery of therapeutic agents. Various hyaluronidases have been used therapeutically (e.g., Hydase™, Vitrase™ and Wydase™), typically as dispersing and spreading agents in combination with other therapeutic agents. Many of these are ovine or bovine forms, which can be immunogenic for treatment of humans. Improved hyaluronan-degrading enzymes, such as hyaluronidases, and compositions thereof that can be used for treatment are needed.

SUMMARY

Provided are modified PH20 polypeptides that have an altered property or properties compared to the PH20 polypeptide that do not have the modification(s). The modifications include amino acid replacement, deletion and/or insertions. Detailed structure/function of virtually each amino acid in a PH20 polypeptide is provided herein, as well as the identification of residues and loci that contribute to alteration of a property, such as stability in particular conditions, is provided. Hence, provided are modified PH20 polypeptides that contain one or more amino acid replacements that result in a PH20 polypeptide that retains activity and/or exhibits increased or altered stability under a variety of conditions. Activity retained can be, for example, hyaluronidase activity that is as least about 40% or more of the PH20 polypeptide that does not include the replacement. Exemplary modifications are amino acid replacements. For purposes herein, amino acid replacements are denoted by the single amino acid letter followed by the corresponding amino acid position in SEQ ID NO:3 in which the replacement occurs. Single amino acid abbreviations for amino acid residues are well known to a skilled artisan (see e.g. Table 1), and are used herein throughout the description and examples. For example, replacement with P at a position corresponding to position 204 in a PH20 polypeptide with reference to amino acid residue positions set forth in SEQ ID NO:3 means that the replacement encompasses F204P in a PH20 polypeptide set forth in SEQ ID NO:3, or the same replacement at the corresponding position in another PH20 polypeptide.

Provided are modified PH20 polypeptides that contain at least one amino acid replacement in a PH20 polypeptide, whereby the modified PH20 polypeptide exhibits increased stability compared to the PH20 polypeptide not containing the amino acid replacement. Increased stability can be manifested as increased resistance to one or more protein conditions that are denaturing to proteins. The stability of modified and unmodified PH20 is compared under the same conditions. Exemplary protein denaturation (or denaturing, used interchangeably herein) conditions include, but are not limited to, elevated temperature greater than 30° C. or about 30° C., agitation, low salt, including essentially or substantially or no salt, and presence of excipients that tend to denature proteins. Exemplary of such excipients are antiadherent(s), binders), coating(s), fillers) and diluent(s), flavors), color(s), lubricant(s), glidant(s), preservative(s), detergent(s), sorbent(s) and combinations thereof.

The modified PH20 polypeptide can be one in which the unmodified form thereof has at least about 68% sequence identity to SEQ ID NO: 3 and further contains modifications that alter stability and/or can be a PH20 polypeptide that includes as many as about up to 100, 110, 120, 130, 150 amino acid differences from PH20 but retains enzymatic activity, particularly, at least about 40% of the activity of the unmodified PH20 polypeptide and exhibits increased stability, such as stability under denaturing conditions. Thus, included are modified PH20 polypeptides that have at least 68% or about 68% amino acid sequence identity to the sequence of amino acids set forth in SEQ ID NO:3. Included are modified PH20 polypeptides that have at least 70%, 75%, 80%, 85%, 86%, 87%, 88%, 89%, 90%, 91%, 92%, 93%, 94%), 95%, 96%, 97%, 98% or 99% amino acid sequence identity to the sequence of amino acids set forth in SEQ ID NO:3. Exemplary of such modified PH20 polypeptides are polypeptides that contain amino acid replacement(s) in a PH20 polypeptide that contains the sequence of amino acid residues as set forth in any of SEQ ID NOS: 3, 7, 10, 12, 14, 24, 32-66, 69, 72, 857, 859, 861, 870 or a sequence of amino acids that is at least 80%, 85%, 86%, 87%, 88%, 89%, 90%, 91%, 92%, 93%, 94%, 95%, 96%, 97%, 98%, 99% identical to any of SEQ ID NOS: 3, 7, 10, 12, 14, 24, 32-66, 69, 72, 857, 859, 861, or 870.

For example, provided herein is a modified PH20 polypeptide that exhibits increased stability containing an amino acid replacement in a PH20 polypeptide that confers the increased stability, wherein increased stability is manifested as increased resistance to denaturation in the presence of one or more protein denaturation conditions, stability is increased compared to the PH20 polypeptide not containing the amino acid replacement, and the unmodified PH20 polypeptide consists of the sequence of amino acids set forth in SEQ ID NO: 7 or is a C-terminal truncated fragment thereof that is a soluble PH20 polypeptide or has at least 85% sequence identity thereto. As above, the modified PH20 polypeptide that exhibits increased stability exhibits increased stability to a denaturation condition that is temperature greater than or about 30° C.; agitation; low or no salt; or presence of an excipient or a denaturing agent, such as an antiadherent(s), binder(s), coating(s), filler(s) and diluent(s), flavor(s), color(s), lubricant(s), glidant(s), preservative(s), detergent(s), sorbent(s) or sweetener(s) and a combination thereof, and in particular a preservative. In some examples of such modified PH20 polypeptides that exhibit increased stability, the denaturation condition is temperature greater than 30° C., and the modified PH20 polypeptide exhibits greater hyaluronidase activity at the temperature compared to the unmodified PH20 polypeptide not containing the amino acid replacement(s) where the activities are compared under the same conditions. In other examples, the protein denaturation condition is the presence of low concentrations of salt of less than 100 mM, and the modified PH20 polypeptide exhibits increased hyaluronidase activity in the presence of low concentrations of salt compared to the unmodified PH20 polypeptide not containing the amino acid replacement(s) where the activities are compared under the same conditions.

In any of the above examples of a modified PH20 polypeptide that exhibits increased stability, stability can be assessed based on a variety of parameters including hyaluronidase activity, solubility, aggregation and/or crystallization. Stability can be assessed in the presence of a denaturing condition. When stability of two or more polypeptides is compared, stability is assessed under the same conditions. In some instances, among the PH20 polypeptides provided herein, the modified PH20 polypeptide exhibits at least 120%, 130%, 135%, 140%, 145%, 150%, 160%, 170%, 180%, 200%, 250%, 300%, 350%, 400%, 500%, 1500%, 2000%, 3000%, 4000%, 5000% or more of the hyaluronidase activity of the PH20 polypeptide not containing the amino acid replacement(s).

In any of the above examples of a modified PH20 polypeptide that exhibits increased stability, denaturing conditions include the presence of excipients that denature proteins. Exemplary of such conditions is the presence of a preservative, such as a phenolic preservative. Provided are modified PH20 polypeptides that exhibit increased stability in the presence of an anti-microbial effective amount of one or more phenolic preservatives. An anti-microbial effective amount is the total amount of one or more phenolic preservative agents, which can be expressed as a percentage (%) of mass concentration (w/v) that is or is between (or at least about or at about) 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4%, inclusive. Exemplary phenolic preservatives include, but are not limited to, phenol, metacresol (m-cresol), benzyl alcohol, and a paraben, such as methylparaben propylparaben, m-cresol, phenol or m-cresol and phenol. Exemplary of the stability achieved by provided modified PH20 polypeptides are those that exhibit at least 15% or about 15% of the hyaluronidase activity for at least 4 hours in the presence of preservative(s) compared to the modified PH20 polypeptide in absence of preservative. Activity is compared under the same conditions except for the presence of preservative(s). For example, provided are modified PH20 polypeptides that exhibit at least (or at least about) 16%, 17%, 18%, 19%, 20%, 25%, 30%, 35%, 40%, 45%, 50%, 55%, 60%, 65%, 65%, 70%, 75%, 80%, 85%, 90%, 95% or more of the hyaluronidase activity in the presence of a phenolic preservative(s) compared to absence of the same preservative(s). Thus, provided, among the modified PH20 polypeptides provided herein, are PH20 polypeptides that, by virtue of amino acid replacement(s), are phenophilic compared to PH20 polypeptides without such replacement. Included are modified PH20 polypeptides where the hyaluronidase activity is exhibited after at least 5 hours, 6 hours, 7 hours, 8 hours, 9 hours, 10 hours, 11 hours, 12 hours, 24 hours, 2 days, 3 days, 4 days, 5 days, 6 days, 7 days, 8 days, 9 days, 10 days, 11 days, 12 days, 13 days, 14 days, 3 weeks, 4 weeks or more in the presence of the preservative(s) compared to the hyaluronidase activity of the modified PH20 polypeptide in the absence of preservative for the same time period and under the same conditions except for the presence of preservative(s).

In examples of a modified PH20 polypeptide that exhibits increased stability to a phenolic preservative, increased stability in a phenolic preservative can be exhibited under temperature conditions that include any temperature between, for example, 0° C. and 40° C., such as between or about between 0° C. to 40° C., 2° C. to 6° C., 24° C. to 32° C. and 35° C. to 40° C. Exemplary polypeptides exhibit increased stability at temperatures of between or about between 30° C. to 45° C., 35° C. to 45° C., 30° C. to 37° C., 35° C. to 37° C. or 37° C. to 42° C., each inclusive. The particular modified PH20 polypeptide and conditions depend upon the intended formulation, conditions to which the formulation will be exposed and/or intended application.

Particular and exemplary modified PH20 polypeptides that exhibit increased stability, such as increased stability to a phenolic preservative, include those that contain a single amino acid modification, such as a replacement, and combinations of modifications, such as at least or 2, 3, 4, 5, 6, 7, 8, 9, 10, 11, 12, 13, 14, 15, 16, 17, 18, 19, 20, 30, 40, 50, 60, 70, 80, 90, 100 and more modifications. These include modified PH20 polypeptides that contain one or more amino acid replacements, where at least one replacement is at an amino acid position corresponding (i.e., by alignment) to a position selected from among 10, 12, 20, 22, 26, 34, 36, 46, 50, 52, 58, 68, 70, 74, 82, 83, 84, 86, 97, 127, 131, 138, 142, 143, 144, 166, 169, 174, 193, 195, 196, 204, 205, 206, 213, 219, 234, 237, 238, 240, 249, 261, 267, 277, 279, 291, 309, 310, 314, 315, 317, 318, 347, 367, 375, 376, 399, 401, 407, 416, 419, 421, 431, 433, 439, 440, 443 or 445 with reference to amino acid positions set forth in SEQ ID NO:3, wherein corresponding amino acid positions are identified by alignment of the PH20 polypeptide with the polypeptide set forth in SEQ ID NO:3. Exemplary of such modifications are at least one amino acid replacement selected from among replacement with: glycine (G) at a position corresponding to position 10; K at a position corresponding to position 12; S at a position corresponding to position 20; T at a position corresponding to position 22; M at a position corresponding to position 26; W at a position corresponding to position 34; N at a position corresponding to position 36; L at a position corresponding to position 46; M at a position corresponding to position 50; T at a position corresponding to position 52; S at a position corresponding to position 52; C at a position corresponding to position 58; K at a position corresponding to position 58; R at a position corresponding to position 58; N at a position corresponding to position 58; Y at a position corresponding to position 58; P at a position corresponding to position 58; H at a position corresponding to position 58; P at a position corresponding to position 68; V at a position corresponding to position 70; E at a position corresponding to position 74; L at a position corresponding to position 82; N at a position corresponding to position 82; V at a position corresponding to position 83; Q at a position corresponding to position 83; S at a position corresponding to position 83; G at a position corresponding to position 83; N at a position corresponding to position 84; A at a position corresponding to position 86; K at a position corresponding to position 86; E at a position corresponding to position 97; L at a position corresponding to position 97; R at a position corresponding to position 127; R at a position corresponding to position 131; L at a position corresponding to position 138; K at a position corresponding to position 142; N at a position corresponding to position 142; P at a position corresponding to position 142; S at a position corresponding to position 142; T at a position corresponding to position 142; G at a position corresponding to position 143; K at a position corresponding to position 143; T at a position corresponding to position 144; Q at a position corresponding to position 166; T at a position corresponding to position 166; L at a position corresponding to position 169; G at a position corresponding to position 174; N at a position corresponding to position 174; Q at a position corresponding to position 193; T at a position corresponding to position 195; N at a position corresponding to position 195; E at a position corresponding to position 196; R at a position corresponding to position 196; P at a position corresponding to position 204; A at a position corresponding to position 205; E at a position corresponding to position 205; I at a position corresponding to position 206; A at a position corresponding to position 213; I at a position corresponding to position 219; M at a position corresponding to position 234; T at a position corresponding to position 237; H at a position corresponding to position 238; Q at a position corresponding to position 240; V at a position corresponding to position 249; A at a position corresponding to position 261; K at a position corresponding to position 261; T at a position corresponding to position 267; K at a position corresponding to position 277; H at a position corresponding to position 279; V at a position corresponding to position 279; V at a position corresponding to position 291; E at a position corresponding to position 309; Q at a position corresponding to position 310; Y at a position corresponding to position 314; Y at a position corresponding to position 315; N at a position corresponding to position 317; W at a position corresponding to position 317; D at a position corresponding to position 318; G at a position corresponding to position 347; A at a position corresponding to position 367; R at a position corresponding to position 375; R at a position corresponding to position 376; V at a position corresponding to position 399; E at a position corresponding to position 401; A at a position corresponding to position 407; L at a position corresponding to position 416; K at a position corresponding to position 419; H at a position corresponding to position 421; E at a position corresponding to position 431; T at a position corresponding to position 433; V at a position corresponding to position 433; C at a position corresponding to position 439; P at a position corresponding to position 440; G at a position corresponding to position 443; N at a position corresponding to position 445, with reference to amino acid residue positions set forth in SEQ ID NO:3. For example, the modified PH20 polypeptide can contain at least one amino acid replacement selected from among replacement with: T at a position corresponding to position 52, K at a position corresponding to position 58, R at a position corresponding to position 58, P at a position corresponding to position 68, V at a position corresponding to position 83, P at a position corresponding to position 204, A at a position corresponding to position 261, T at a position corresponding to position 267, K at a position corresponding to position 277 and H at a position corresponding to position 421, with reference to amino acid residue positions set forth in SEQ ID NO:3. An exemplary modified PH20 polypeptide is one that includes P (or a conservative amino acid thereto) at a position corresponding to position 204 in a PH20 polypeptide with reference to amino acid residue positions set forth in SEQ ID NO:3.

Thus, provided herein are modified PH20 polypeptides that exhibit increased stability in the presence of a phenolic preservative containing an amino acid replacement in a PH20 polypeptide that confers the increased stability, wherein stability is increased compared to the unmodified polypeptide without the amino acid replacement, and the unmodified PH20 polypeptide has the sequence of amino acids set forth in SEQ ID NO: 7 or is a C-terminal truncated fragment thereof that is a soluble PH20 polypeptide or has at least 85% sequence identity thereto. For example, the unmodified PH20 polypeptide is a soluble PH20 polypeptide that has the sequence of amino acids set forth in any of SEQ ID NOS: 3 or 32-66. In particular examples, the modified PH20 polypeptide has at least 85% sequence identity to SEQ ID NO:3. In any of such examples of a modified PH20 polypeptide, the polypeptide contains 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75 or more amino acid replacements. In examples herein, the modified PH20 polypeptide is a human PH20. The modified PH20 polypeptide exhibits stability in the presence of phenolic preservatives if it exhibits at least 15% of the hyaluronidase activity in the presence of a preservative(s) for at least 4 hours compared to the hyaluronidase activity in the absence of the phenolic preservative(s), wherein the activity is compared under the same conditions except for the presence of the phenolic preservative(s). In any of the above examples, the modified PH20 polypeptide is stable in the presence of an of an anti-microbial effective amount of one or more phenolic preservatives, such as a total amount of one or more phenolic preservative agents as a percentage (%) of mass concentration (w/v) that is from or from about 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4%, inclusive. The phenolic preservative can be a phenol, metacresol (m-cresol), benzyl alcohol or a paraben, such as m-cresol, phenol, or m-cresol and phenol. The amino acid replacement can be at amino acid residue 204, 58, 10, 12, 20, 22, 26, 34, 36, 46, 50, 52, 68, 70, 74, 82, 83, 84, 86, 97, 127, 131, 138, 142, 143, 144, 166, 169, 174, 193, 195, 196, 205, 206, 213, 219, 234, 237, 238, 240, 249, 261, 267, 277, 279, 291, 309, 310, 314, 315, 317, 318, 347, 367, 375, 376, 399, 401, 407, 416, 419, 421, 431, 433, 439, 440, 443 or 445 with reference to amino acid positions set forth in SEQ ID NO:3, wherein corresponding amino acid positions are identified by alignment of the PH20 polypeptide with the polypeptide set forth in SEQ ID NO:3. For example, the amino acid replacement is G at a position corresponding to position 10; K at a position corresponding to position 12; S at a position corresponding to position 20; T at a position corresponding to position 22; M at a position corresponding to position 26; W at a position corresponding to position 34; N at a position corresponding to position 36; L at a position corresponding to position 46; M at a position corresponding to position 50; T at a position corresponding to position 52; S at a position corresponding to position 52; C at a position corresponding to position 58; K at a position corresponding to position 58; R at a position corresponding to position 58; N at a position corresponding to position 58; Y at a position corresponding to position 58; P at a position corresponding to position 58; H at a position corresponding to position 58; P at a position corresponding to position 68; V at a position corresponding to position 70; E at a position corresponding to position 74; L at a position corresponding to position 82; N at a position corresponding to position 82; V at a position corresponding to position 83; Q at a position corresponding to position 83; S at a position corresponding to position 83; G at a position corresponding to position 83; N at a position corresponding to position 84; A at a position corresponding to position 86; K at a position corresponding to position 86; E at a position corresponding to position 97; L at a position corresponding to position 97; R at a position corresponding to position 127; R at a position corresponding to position 131; L at a position corresponding to position 138; K at a position corresponding to position 142; N at a position corresponding to position 142; P at a position corresponding to position 142; S at a position corresponding to position 142; T at a position corresponding to position 142; G at a position corresponding to position 143; K at a position corresponding to position 143; T at a position corresponding to position 144; Q at a position corresponding to position 166; T at a position corresponding to position 166; L at a position corresponding to position 169; G at a position corresponding to position 174; N at a position corresponding to position 174; Q at a position corresponding to position 193; T at a position corresponding to position 195; N at a position corresponding to position 195; E at a position corresponding to position 196; R at a position corresponding to position 196; P at a position corresponding to position 204; A at a position corresponding to position 205; E at a position corresponding to position 205; I at a position corresponding to position 206; A at a position corresponding to position 213; I at a position corresponding to position 219; M at a position corresponding to position 234; T at a position corresponding to position 237; H at a position corresponding to position 238; Q at a position corresponding to position 240; V at a position corresponding to position 249; A at a position corresponding to position 261; K at a position corresponding to position 261; T at a position corresponding to position 267; K at a position corresponding to position 277; H at a position corresponding to position 279; V at a position corresponding to position 279; V at a position corresponding to position 291; E at a position corresponding to position 309; Q at a position corresponding to position 310; Y at a position corresponding to position 314; Y at a position corresponding to position 315; N at a position corresponding to position 317; W at a position corresponding to position 317; D at a position corresponding to position 318; G at a position corresponding to position 347; A at a position corresponding to position 367; R at a position corresponding to position 375; R at a position corresponding to position 376; V at a position corresponding to position 399; E at a position corresponding to position 401; A at a position corresponding to position 407; L at a position corresponding to position 416; K at a position corresponding to position 419; H at a position corresponding to position 421; E at a position corresponding to position 431; T at a position corresponding to position 433; V at a position corresponding to position 433; C at a position corresponding to position 439; P at a position corresponding to position 440; G at a position corresponding to position 443; or N at a position corresponding to position 445, with reference to amino acid residue positions set forth in SEQ ID NO:3. In particular, the amino acid replacement is T at a position corresponding to position 52, K at a position corresponding to position 58, R at a position corresponding to position 58, P at a position corresponding to position 68, V at a position corresponding to position 83, P at a position corresponding to position 204, A at a position corresponding to position 261, T at a position corresponding to position 267, K at a position corresponding to position 277 or H at a position corresponding to position 421, with reference to amino acid residue positions set forth in SEQ ID NO:3, such as replacement with P at a position corresponding to position 204 or R at a position corresponding to position 58. The modified PH20 polypeptide that exhibits increased stability to phenolic preservatives can be substantially purified or isolated. The modified PH20 polypeptide that exhibits increased stability to phenolic preservatives can be modified by glycosylation, sialation, albumination, farnysylation, carboxylation, hydroxylation and phosphorylation, and generally is glycosylated, whereby the polypeptide contains at least an N-acetylglucosamine moiety linked to each of at least three asparagine (N) residues, such as at amino acid residues corresponding to amino acid residues 200, 333 and 358 of SEQ ID NO:3. The modified PH20 polypeptide that exhibits increased stability to phenolic preservatives can be conjugated to a polymer, such as PEG or dextran and/or can be conjugated to a moiety that is a multimerization domain, a toxin, a detectable label or a drug.

Among modified PH20 polypeptides provided herein that exhibit increased stability are those that exhibit increased hyaluronidase activity at the elevated temperature compared to the PH20 polypeptide not containing the amino acid replacement(s), such as at least 110%, 120%, 130%, 140%, 150%, 160%, 170%, 180%, 190%, 200%, 300%, 400%, 500% or more hyaluronidase activity for at least 4 hours compared to the PH20 polypeptide not containing the amino acid replacement(s). Also among the polypeptides are those that exhibit activity, but also typically exhibit increased stability or other property at elevated temperatures, such as a modified PH20 polypeptide that exhibits at least 95%, 96%, 97%, 98%, 99%, 100%, 110%, 120%, 130%, 140%, 150%, 160%, 170%, 180%, 190%, 200%, 300%, 400%, 500% of the hyaluronidase activity for at least 4 hours at a temperature of between or about between 32° C. to 37° C. compared to the hyaluronidase activity of the modified PH20 polypeptide at a temperature of between or about between 2° C. to 8° C., where activity is compared under the same conditions except for the differences in temperature. The hyaluronidase activity can be exhibited after at least 5 hours, 6 hours, 7 hours, 8 hours, 9 hours, 10 hours, 11 hours, 12 hours, 24 hours, 2 days, 3 days, 4 days, 5 days, 6 days, 7 days, 8 days, 9 days, 10 days, 11 days, 12 days, 13 days, 14 days, 3 weeks, 4 weeks or more at elevated temperatures of between or about between 32° C. to 37° C. compared to the hyaluronidase activity of the modified PH20 polypeptide at a temperature between or about between 2° C. to 8° C., where activity is compared for the same time period and under the same conditions except for the difference in temperature. Exemplary of such modified polypeptides are those that contain at least one amino acid replacement at an amino acid position corresponding to a position selected from among 1, 11, 12, 14, 20, 26, 29, 34, 50, 58, 70, 82, 83, 84, 86, 87, 140, 142, 143, 147, 152, 166, 167, 172, 174, 178, 193, 195, 206, 212, 213, 219, 233, 237, 240, 267, 277, 291, 292, 309, 313, 314, 317, 318, 347, 367, 368, 371, 374, 389, 392, 395, 396, 406, 419, 421, 439 and 443 with reference to amino acid positions set forth in SEQ ID NO:3, wherein corresponding amino acid positions are identified by alignment of the PH20 polypeptide with the polypeptide set forth in SEQ ID NO:3. Exemplary mutations include, for example, replacement with R at a position corresponding to position 1; S at a position corresponding to position 11; I at a position corresponding to position 12; V at a position corresponding to position 14; S at a position corresponding to position 20; M at a position corresponding to position 26; with R at a position corresponding to position 29; W at a position corresponding to position 34; M at a position corresponding to position 50; K at a position corresponding to position 58; Q at a position corresponding to position 58; Q at a position corresponding to position 58; V at a position corresponding to position 70; L at a position corresponding to position 82; Q at a position corresponding to position 83; R at a position corresponding to position 84; A at a position corresponding to position 86; S at a position corresponding to position 87; K at a position corresponding to position 140; S at a position corresponding to position 142; T at a position corresponding to position 142; K at a position corresponding to position 143; S at a position corresponding to position 147; T at a position corresponding to position 152; T at a position corresponding to position 166; D at a position corresponding to position 167; A at a position corresponding to position 172; G at a position corresponding to position 174; N at a position corresponding to position 174; R at a position corresponding to position 178; Q at a position corresponding to position 193; T at a position corresponding to position 195; I at a position corresponding to position 206; S at a position corresponding to position 212; A at a position corresponding to position 213; I at a position corresponding to position 219; G at a position corresponding to position 233; T at a position corresponding to position 237; A at a position corresponding to position 240; Q at a position corresponding to position 240; T at a position corresponding to position 267; E at a position corresponding to position 277; S at a position corresponding to position 291; H at a position corresponding to position 292; V at a position corresponding to position 292; S at a position corresponding to position 309; H at a position corresponding to position 313; S at a position corresponding to position 314; I at a position corresponding to position 317; T at a position corresponding to position 317; W at a position corresponding to position 317; R at a position corresponding to position 318; G at a position corresponding to position 347; A at a position corresponding to position 367; R at a position corresponding to position 368; S at a position corresponding to position 371; P at a position corresponding to position 374; A at a position corresponding to position 389; V at a position corresponding to position 392; A at a position corresponding to position 395; H at a position corresponding to position 396; N at a position corresponding to position 406; H at a position corresponding to position 419; K at a position corresponding to position 419; R at a position corresponding to position 421; S at a position corresponding to position 421; A at a position corresponding to position 439; C at a position corresponding to position 439; and G at a position corresponding to position 443, with reference to amino acid positions set forth in SEQ ID NO:3. In particular examples provided herein, any of such modified PH20 polypeptides contain a single amino acid modification, such as a replacement, and combinations of modifications, such as at least or 2, 3, 4, 5, 6, 7, 8, 9, 10, 11, 12, 13, 14, 15, 16, 17, 18, 19, 20, 30, 40, 50, 60, 70, 80, 90, 100 and more modifications. The modification, such as replacement, can be in an unmodified PH20 polypeptide that has the sequence of amino acids set forth in SEQ ID NO: 7 or is a C-terminal truncated fragment thereof that is a soluble PH20 polypeptide, such as is set forth in any of SEQ ID NOS: 3 or 32-66, or has at least 85% sequence identity thereto. For example, any of such modified PH20 polypeptides has at least 85% sequence identity to SEQ ID NO:3.

Also provided are modified PH20 polypeptides that exhibit increased stability in low salt conditions, such as, for example, concentrations of NaCl of less than 100 mM, such as, but not limited to concentrations of NaCl less than 90 mM, 80 mM, 70 mM, 60 mM, 50 mM, 40 mM, 30 mM, 25 mM, 20 mM, 15 mM, 10 mM, 5 mM or less. Among the modified PH20 polypeptides are those that exhibit increased hyaluronidase activity at lower concentrations of salt compared to the PH20 polypeptide not containing the amino acid replacement(s). Such activity includes, for example, at least more than 100%, or at least 110%, 120%, 130%, 140%, 150%, 160%, 170%, 180%, 190%, 200%, 300%, 400%, 500% or more hyaluronidase activity compared to the PH20 polypeptide not containing the amino acid replacement(s). Exemplary of such modified PH20 polypeptides are those that exhibit at least 60% of the hyaluronidase activity in low concentrations of salt, such as between or about between 10 mM NaCl and 100 mM NaCl, inclusive (or comparable concentrations of other salts or mixtures of salts), compared to the hyaluronidase activity of the modified PH20 polypeptide in 150 mM NaCl, where activities are compared under the same conditions except for the difference in salt concentration. In particular examples provided herein, any of such modified PH20 polypeptides contain a single amino acid modification, such as a replacement, and combinations of modifications, such as at least or 2, 3, 4, 5, 6, 7, 8, 9, 10, 11, 12, 13, 14, 15, 16, 17, 18, 19, 20, 30, 40, 50, 60, 70, 80, 90, 100 and more modifications. The modification, such as replacement, can be in an unmodified PH20 polypeptide that has the sequence of amino acids set forth in SEQ ID NO: 7 or is a C-terminal truncated fragment thereof that is a soluble PH20 polypeptide, such as is set forth in any of SEQ ID NOS: 3 or 32-66, or has at least 85% sequence identity thereto. For example, any of such modified PH20 polypeptides has at least 85% sequence identity to SEQ ID NO:3.

Also provided are modified PH20 polypeptides that contain at least one amino acid replacement in a PH20 polypeptide, where the modified PH20 polypeptide exhibits increased hyaluronidase activity compared to the PH20 polypeptide not containing the amino acid replacement. When comparing activity among polypeptides, activity is compared under the same conditions. Among these are polypeptides, where the unmodified PH20 exhibits at least 68%, 70%, 75%, 80%, 85%, 86%, 87%, 88%, 89%, 90%, 91%, 92%, 93%, 94%, 95%, 96%, 97%, 98% or 99% amino acid sequence identity to the sequence of amino acids set forth in SEQ ID NO:3, or the resulting modified PH20 exhibits such sequence identity to the sequence of amino acids set forth in SEQ ID NO:3. Exemplary of such modified PH20 polypeptides are any that contain an amino acid replacement(s) in the sequence of amino acids set forth in any of SEQ ID NOS: 3, 7, 10, 12, 14, 24, 32-66, 69, or 72, or a sequence of amino acids that is at least 80%, 85%, 86%, 87%, 88%, 89%, 90%, 91%, 92%, 93%, 94%, 95%, 96%, 97%, 98%, 99% identical to any of SEQ ID NOS: 3, 7, 10, 12, 14, 24, 32-66, 69, or 72. The amino acid replacement(s) also can be made in the sequence of amino acids set forth in any of SEQ ID NOS: 857, 859, 861 or 870, or a sequence of amino acids that is at least 80%, 85%, 86%, 87%, 88%, 89%, 90%, 91%, 92%, 93%, 94%, 95%, 96%, 97%, 98%, 99% identical to any of SEQ ID NOS: 857, 859, 861 or 870. In particular, provided are modified PH20 polypeptides that contain an amino acid replacement in the sequence of amino acids set forth in SEQ ID NOS: 3, 7, 32-66, 69 or 72. Among the modified PH20 polypeptides are those that that exhibit at least 120%, 130%, 135%, 140%, 145%, 150%, 160%, 170%, 180%, 200%, 250%, 300%, 350%, 400%, 500%, 1500%, 2000%, 3000%, 4000%, 5000% or more of the hyaluronidase activity of the PH20 polypeptide not containing the amino acid replacement. Activity can be assessed at any temperature, in particular such activity is present when the hyaluronidase is exposed to a temperature that is at a temperature between or about between 2° C. to 8° C. These modified PH20 polypeptides contain at least one amino acid replacement at an amino acid position corresponding to a position selected from among 1, 12, 15, 24, 26, 27, 29, 30, 31, 32, 33, 37, 39, 46, 48, 52, 58, 63, 67, 68, 69, 70, 71, 72, 73, 74, 75, 84, 86, 87, 92, 93, 94, 97, 118, 120, 127, 131, 135, 141, 142, 147, 148, 150, 151, 152, 155, 156, 163, 164, 165, 166, 169, 170, 174, 198, 206, 209, 212, 213, 215, 219, 233, 234, 236, 238, 247, 257, 259, 260, 261, 263, 269, 271, 272, 276, 277, 278, 282, 291, 293, 305, 308, 309, 310, 313, 315, 317, 318, 320, 324, 325, 326, 328, 347, 353, 359, 371, 377, 380, 389, 392, 395, 399, 405, 407, 409, 410, 418, 419, 421, 425, 431, 433, 436, 437, 438, 439, 440, 441, 442, 443, 445, 446 and 447 with reference to amino acid positions set forth in SEQ ID NO:3, wherein corresponding amino acid positions are identified by alignment of the PH20 polypeptide with the polypeptide set forth in SEQ ID NO:3. Exemplary modifications include at least one amino acid replacement selected from among replacement with: histidine (H) at a position corresponding to position 1; Q at a position corresponding to position 1; E at a position corresponding to position 12; T at a position corresponding to position 12; V at a position corresponding to position 15; E at a position corresponding to position 24; H at a position corresponding to position 24; E at a position corresponding to position 26; K at a position corresponding to position 26; K at a position corresponding to position 27; R at a position corresponding to position 27; E at a position corresponding to position 29; I at a position corresponding to position 29; L at a position corresponding to position 29; M at a position corresponding to position 29; P at a position corresponding to position 29; S at a position corresponding to position 29; V at a position corresponding to position 29; G at a position corresponding to position 30; H at a position corresponding to position 30; K at a position corresponding to position 30; M at a position corresponding to position 30; R at a position corresponding to position 30; S at a position corresponding to position 30; A at a position corresponding to position 31; C at a position corresponding to position 31; H at a position corresponding to position 31; I at a position corresponding to position 31; K at a position corresponding to position 31; L at a position corresponding to position 31; P at a position corresponding to position 31; R at a position corresponding to position 31; S at a position corresponding to position 31; T at a position corresponding to position 31; V at a position corresponding to position 31; F at a position corresponding to position 32; G at a position corresponding to position 32; H at a position corresponding to position 32; W at a position corresponding to position 33; F at a position corresponding to position 37; N at a position corresponding to position 39; T at a position corresponding to position 39; R at a position corresponding to position 46; F at a position corresponding to position 48; H at a position corresponding to position 48; N at a position corresponding to position 48; Q at a position corresponding to position 52; K at a position corresponding to position 58; Q at a position corresponding to position 58; W at a position corresponding to position 63; V at a position corresponding to position 67; H at a position corresponding to position 68; Q at a position corresponding to position 68; A at a position corresponding to position 69; C at a position corresponding to position 69; F at a position corresponding to position 69; G at a position corresponding to position 69; I at a position corresponding to position 69; L at a position corresponding to position 69; M at a position corresponding to position 69; P at a position corresponding to position 69; R at a position corresponding to position 69; W at a position corresponding to position 69; Y at a position corresponding to position 69; A at a position corresponding to position 70; C at a position corresponding to position 70; F at a position corresponding to position 70; G at a position corresponding to position 70; H at a position corresponding to position 70; K at a position corresponding to position 70; L at a position corresponding to position 70; N at a position corresponding to position 70; P at a position corresponding to position 70; R at a position corresponding to position 70; S at a position corresponding to position 70; T at a position corresponding to position 70; V at a position corresponding to position 70; R at a position corresponding to position 71; S at a position corresponding to position 71; M at a position corresponding to position 72; Q at a position corresponding to position 72; H at a position corresponding to position 73; L at a position corresponding to position 73; W at a position corresponding to position 73; A at a position corresponding to position 74; C at a position corresponding to position 74; G at a position corresponding to position 74; N at a position corresponding to position 74; P at a position corresponding to position 74; R at a position corresponding to position 74; S at a position corresponding to position 74; V at a position corresponding to position 74; W at a position corresponding to position 74; F at a position corresponding to position 75; L at a position corresponding to position 75; R at a position corresponding to position 75; T at a position corresponding to position 75; G at a position corresponding to position 84; R at a position corresponding to position 84; A at a position corresponding to position 86; C at a position corresponding to position 87; T at a position corresponding to position 87; Y at a position corresponding to position 87; C at a position corresponding to position 92; I at a position corresponding to position 93; L at a position corresponding to position 93; R at a position corresponding to position 93; T at a position corresponding to position 93; R at a position corresponding to position 94; G at a position corresponding to position 97; Q at a position corresponding to position 118; F at a position corresponding to position 120; V at a position corresponding to position 120; Y at a position corresponding to position 120; H at a position corresponding to position 127; N at a position corresponding to position 127; G at a position corresponding to position 131; R at a position corresponding to position 131; V at a position corresponding to position 131; D at a position corresponding to position 135; G at a position corresponding to position 135; R at a position corresponding to position 135, with H at a position corresponding to position 141; Y at a position corresponding to position 141; R at a position corresponding to position 142; R at a position corresponding to position 147; V at a position corresponding to position 147; K at a position corresponding to position 148; G at a position corresponding to position 150; K at a position corresponding to position 151; L at a position corresponding to position 151; M at a position corresponding to position 151; Q at a position corresponding to position 151; R at a position corresponding to position 151; R at a position corresponding to position 152; G at a position corresponding to position 155; K at a position corresponding to position 155; D at a position corresponding to position 156; A at a position corresponding to position 163; E at a position corresponding to position 163; K at a position corresponding to position 163; R at a position corresponding to position 163; M at a position corresponding to position 164; D at a position corresponding to position 165; N at a position corresponding to position 165; A at a position corresponding to position 166; F at a position corresponding to position 166; H at a position corresponding to position 166; L at a position corresponding to position 166; Q at a position corresponding to position 166; R at a position corresponding to position 166; T at a position corresponding to position 166; Y at a position corresponding to position 166; L at a position corresponding to position 169; R at a position corresponding to position 170; K at a position corresponding to position 174; D at a position corresponding to position 198; K at a position corresponding to position 206; L at a position corresponding to position 206; N at a position corresponding to position 212; M at a position corresponding to position 213; N at a position corresponding to position 213; M at a position corresponding to position 215; S at a position corresponding to position 219; K at a position corresponding to position 233; R at a position corresponding to position 233; M at a position corresponding to position 234; R at a position corresponding to position 236; E at a position corresponding to position 237; S at a position corresponding to position 238; I at a position corresponding to position 247; T at a position corresponding to position 257; P at a position corresponding to position 259; Y at a position corresponding to position 260; K at a position corresponding to position 261; N at a position corresponding to position 261; K at a position corresponding to position 263; R at a position corresponding to position 263; A at a position corresponding to position 269; L at a position corresponding to position 271; M at a position corresponding to position 271; T at a position corresponding to position 272; D at a position corresponding to position 276; S at a position corresponding to position 276; Y at a position corresponding to position 276; K at a position corresponding to position 277; R at a position corresponding to position 277; T at a position corresponding to position 277; H at a position corresponding to position 278; K at a position corresponding to position 278; N at a position corresponding to position 278; R at a position corresponding to position 278; S at a position corresponding to position 278; T at a position corresponding to position 278; Y at a position corresponding to position 278; M at a position corresponding to position 282; V at a position corresponding to position 291; A at a position corresponding to position 293; C at a position corresponding to position 293; F at a position corresponding to position 293; M at a position corresponding to position 293; P at a position corresponding to position 293; Q at a position corresponding to position 293; V at a position corresponding to position 293; E at a position corresponding to position 305; G at a position corresponding to position 308; N at a position corresponding to position 308; E at a position corresponding to position 309; L at a position corresponding to position 309; N at a position corresponding to position 309; Q at a position corresponding to position 309; R at a position corresponding to position 309; T at a position corresponding to position 309; A at a position corresponding to position 310; G at a position corresponding to position 310; K at a position corresponding to position 313; R at a position corresponding to position 313; H at a position corresponding to position 315; I at a position corresponding to position 317; K at a position corresponding to position 317; R at a position corresponding to position 317; M at a position corresponding to position 318; H at a position corresponding to position 320; K at a position corresponding to position 320; R at a position corresponding to position 320; R at a position corresponding to position 324; A at a position corresponding to position 325; D at a position corresponding to position 325; E at a position corresponding to position 325; G at a position corresponding to position 325; H at a position corresponding to position 325; K at a position corresponding to position 325; M at a position corresponding to position 325; N at a position corresponding to position 325; Q at a position corresponding to position 325; S at a position corresponding to position 325; V at a position corresponding to position 326; I at a position corresponding to position 328; K at a position corresponding to position 328; L at a position corresponding to position 328; S at a position corresponding to position 328; Y at a position corresponding to position 328; G at a position corresponding to position 347; S at a position corresponding to position 347; V at a position corresponding to position 353; with T at a position corresponding to position 359; R at a position corresponding to position 371; P at a position corresponding to position 377; T at a position corresponding to position 377; W at a position corresponding to position 380; Y at a position corresponding to position 380; K at a position corresponding to position 389; M at a position corresponding to position 392; R at a position corresponding to position 395; M at a position corresponding to position 399; T at a position corresponding to position 399; W at a position corresponding to position 399; G at a position corresponding to position 405; D at a position corresponding to position 407; Q at a position corresponding to position 407; A at a position corresponding to position 409; Q at a position corresponding to position 409; T at a position corresponding to position 410; P at a position corresponding to position 418; F at a position corresponding to position 419; I at a position corresponding to position 419; K at a position corresponding to position 419; R at a position corresponding to position 419; S at a position corresponding to position 419; H at a position corresponding to position 421; K at a position corresponding to position 421; N at a position corresponding to position 421; Q at a position corresponding to position 421; R at a position corresponding to position 421; S at a position corresponding to position 421; K at a position corresponding to position 425; A at a position corresponding to position 431; H at a position corresponding to position 431; K at a position corresponding to position 431; Q at a position corresponding to position 431; R at a position corresponding to position 431; S at a position corresponding to position 431; V at a position corresponding to position 431; L at a position corresponding to position 433; R at a position corresponding to position 433; T at a position corresponding to position 433; V at a position corresponding to position 433; K at a position corresponding to position 436; I at a position corresponding to position 437; M at a position corresponding to position 437; T at a position corresponding to position 438; V at a position corresponding to position 439; H at a position corresponding to position 440; R at a position corresponding to position 440; F at a position corresponding to position 441; R at a position corresponding to position 442; A at a position corresponding to position 443; M at a position corresponding to position 443; M at a position corresponding to position 445; P at a position corresponding to position 445; A at a position corresponding to position 446; D at a position corresponding to position 447; N at a position corresponding to position 447; and/or with Q at a position corresponding to position 447, with reference to amino acid positions set forth in SEQ ID NO:3.

Among the polypeptides that exhibit increased hyaluronidase activity are those that exhibit at least 2.0-fold of the hyaluronidase activity of the PH20 polypeptide not containing the amino acid replacement. For example, among these are modified PH20 polypeptides that contain at least one amino acid replacement at an amino acid position corresponding to a position selected from among 24, 29, 31, 48, 58, 69, 70, 75, 84, 97, 165, 166, 271, 278, 317, 320, 325 and 326 with reference to positions set forth in SEQ ID NO:3, wherein corresponding amino acid positions are identified by alignment of the PH20 polypeptide with the polypeptide set forth in SEQ ID NO:3, such as modified PH20 polypeptides that contain at least one amino acid replacement selected from among replacement with: E at a position corresponding to position 24; E at a position corresponding to position 29; V at a position corresponding to position 31; N at a position corresponding to position 48; K at a position corresponding to position 58; Q at a position corresponding to position 58; A at a position corresponding to position 69; F at a position corresponding to position 69; G at a position corresponding to position 69; P at a position corresponding to position 69; R at a position corresponding to position 69; A at a position corresponding to position 70; F at a position corresponding to position 70; G at a position corresponding to position 70; H at a position corresponding to position 70; H at a position corresponding to position 70; N at a position corresponding to position 70; R at a position corresponding to position 70; T at a position corresponding to position 70; V at a position corresponding to position 70; L at a position corresponding to position 75; T at a position corresponding to position 75; G at a position corresponding to position 84; G at a position corresponding to position 97; D at a position corresponding to position 165; L at a position corresponding to position 166; R at a position corresponding to position 166; T at a position corresponding to position 166; L at a position corresponding to position 271; H at a position corresponding to position 278; R at a position corresponding to position 278; K at a position corresponding to position 317; K at a position corresponding to position 320; E at a position corresponding to position 325, with G at a position corresponding to position 325; K at a position corresponding to position 325; N at a position corresponding to position 325; Q at a position corresponding to position 325; and V at a position corresponding to position 326; with reference to amino acid positions set forth in SEQ ID NO:3.

Among any of the polypeptides provided herein that exhibit increased hyaluronidase activity, any of such modified PH20 polypeptides contain a single amino acid modification, such as a replacement, and combinations of modifications, such as at least or 2, 3, 4, 5, 6, 7, 8, 9, 10, 11, 12, 13, 14, 15, 16, 17, 18, 19, 20, 30, 40, 50, 60, 70, 80, 90, 100 and more modifications. The modification, such as replacement, can be in an unmodified PH20 polypeptide that has the sequence of amino acids set forth in SEQ ID NO: 7 or is a C-terminal truncated fragment thereof that is a soluble PH20 polypeptide, such as is set forth in any of SEQ ID NOS: 3 or 32-66, or has at least 85% sequence identity thereto. For example, any of such modified PH20 polypeptides has at least 85% sequence identity to SEQ ID NO:3.

Also provided are modified PH20 polypeptides that contain at least one amino acid replacement in the PH20 polypeptide whose sequence is set forth in SEQ ID NO:7, a C-terminally truncated fragment thereof, a soluble fragment thereof, or in a PH20 polypeptide that has a sequence of amino acids that is at least 91% identical to the sequence of amino acids set forth in SEQ ID NO:7, where at least one amino replacement(s) is at an amino acid position corresponding to a position selected from among 1, 2, 3, 4, 5, 6, 8, 9, 10, 11, 12, 13, 14, 15, 20, 22, 23, 24, 26, 27, 28, 29, 30, 31, 32, 33, 34, 35, 36, 37, 38, 39, 40, 41, 42, 43, 44, 45, 46, 47, 48, 49, 50, 51, 52, 54, 58, 59, 60, 61, 63, 65, 66, 67, 68, 69, 70, 71, 72, 73, 74, 75, 77, 79, 81, 82, 83, 84, 85, 86, 87, 89, 90, 91, 92, 93, 94, 96, 97, 98, 99, 102, 103, 104, 105, 106, 107, 108, 110, 114, 117, 118, 119, 120, 122, 124, 125, 127, 128, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 186, 192, 193, 195, 196, 197, 198, 200, 202, 204, 205, 206, 208, 209, 211, 212, 213, 214, 215, 216, 217, 218, 219, 220, 221, 222, 224, 226, 230, 231, 232, 233, 234, 235, 236, 237, 238, 239, 240, 242, 245, 247, 248, 251, 253, 255, 256, 257, 258, 259, 260, 261, 263, 264, 265, 266, 267, 269, 270, 271, 272, 273, 274, 275, 276, 277, 278, 279, 280, 282, 283, 284, 285, 286, 287, 288, 289, 290, 291, 292, 293, 294, 297, 298, 300, 301, 302, 304, 305, 306, 307, 308, 309, 310, 311, 312, 313, 314, 315, 316, 317, 318, 320, 321, 323, 324, 325, 326, 327, 328, 331, 334, 335, 338, 339, 342, 343, 347, 348, 349, 351, 353, 356, 357, 358, 359, 360, 361, 367, 368, 369, 371, 373, 374, 375, 376, 377, 378, 379, 380, 381, 383, 385, 387, 388, 389, 391, 392, 393, 394, 395, 396, 397, 398, 399, 401, 403, 404, 405, 406, 407, 409, 410, 411, 412, 413, 414, 415, 416, 417, 418, 419, 420, 421, 422, 425, 426, 427, 428, 431, 432, 433, 434, 435, 436, 437, 438, 439, 440, 441, 442, 443, 444, 445, 446 and 447 with reference to amino acid positions set forth in SEQ ID NO:3 or 7, where corresponding amino acid positions are identified by alignment of the PH20 polypeptide with the polypeptide set forth in SEQ ID NO:3; and provided that if the modified PH20 polypeptide contains an amino acid replacement at a position corresponding to position 13, 47, 131, or 219 the replacement is not replacement with an Alanine (A). Among these modified PH20 polypeptides are those that exhibit at least 40% of the hyaluronidase activity of the PH20 polypeptide not containing the amino acid replacement, where, as in all instances herein activity is compared under the same conditions.

Included among these polypeptides are those that contain an amino acid replacement in the sequence of amino acids set forth in any of SEQ ID NOS: 3, 7, 32-66, 69 and 72, or in a sequence of amino acids that exhibits at least 91% sequence identity to any of SEQ ID NOS: 3, 7, 32-66, 69, or 72. In particular, the modified PH20 polypeptide contains amino acid replacements in SEQ ID NO: 3, 7, 32-66, 69; or 72, which are polypeptides that are a C-terminally truncated fragment of SEQ ID NO:7, or a PH20 polypeptide that has a sequence of amino acids that is at least 91% identical to the sequence of amino acids set forth in SEQ ID NO: 7. In particular, among any of such modified PH20 polypeptides provided herein are any including those in which the amino acid replacement is an amino acid replacement set forth in Table 3 below. For example, such modified PH20 polypeptides include those that have at least one amino acid replacement at an amino acid position corresponding to a position selected from among 1, 6, 8, 9, 10, 11, 12, 14, 15, 20, 22, 24, 26, 27, 28, 29, 30, 31, 32, 33, 34, 35, 36, 37, 38, 39, 40, 41, 46, 47, 48, 49, 50, 52, 58, 59, 63, 67, 68, 69, 70, 71, 72, 73, 74, 75, 79, 82, 83, 84, 86, 87, 89, 90, 92, 93, 94, 97, 102, 104, 107, 114, 118, 120, 127, 128, 130, 131, 132, 135, 138, 139, 140, 141, 142, 143, 144, 146, 147, 148, 149, 150, 151, 152, 155, 156, 158, 160, 162, 163, 164, 165, 166, 167, 169, 170, 172, 173, 174, 175, 178, 179, 193, 195, 196, 198, 204, 205, 206, 209, 212, 213, 215, 219, 220, 221, 222, 232, 233, 234, 235, 236, 237, 238, 240, 247, 248, 249, 257, 258, 259, 260, 261, 263, 267, 269, 271, 272, 273, 274, 276, 277, 278, 279, 282, 283, 285, 287, 289, 291, 292, 293, 298, 305, 307, 308, 309, 310, 313, 314, 315, 317, 318, 320, 321, 324, 325, 326, 328, 335, 347, 349, 351, 353, 356, 359, 367, 368, 369, 371, 373, 374, 375, 376, 377, 380, 381, 383, 385, 389, 392, 393, 395, 396, 399, 401, 404, 405, 406, 407, 409, 410, 412, 416, 418, 419, 421, 425, 427, 428, 431, 433, 436, 437, 438, 439, 440, 441, 442, 443, 444, 445, 446 or 447 with reference to amino acid positions set forth in SEQ ID NO:3. Exemplary of such replacements are those that contain at least one amino acid replacement selected from among replacement with: histidine (H) at a position corresponding to position 1; A at a position corresponding to position 1; E at a position corresponding to position 1; G at a position corresponding to position 1; K at a position corresponding to position 1; Q at a position corresponding to position 1; R at a position corresponding to position 1; A at a position corresponding to position 6; M at a position corresponding to position 8; Q at a position corresponding to position 9; G at a position corresponding to position 10; H at a position corresponding to position 10; S at a position corresponding to position 11; E at a position corresponding to position 12; I at a position corresponding to position 12; K at a position corresponding to position 12; T at a position corresponding to position 12; V at a position corresponding to position 14; V at a position corresponding to position 15; M at a position corresponding to position 15; S at a position corresponding to position 20; T at a position corresponding to position 22; E at a position corresponding to position 24; H at a position corresponding to position 24; R at a position corresponding to position 24; A at a position corresponding to position 26; E at a position corresponding to position 26; K at a position corresponding to position 26; M at a position corresponding to position 26; Q at a position corresponding to position 26; R at a position corresponding to position 26; D at a position corresponding to position 27; K at a position corresponding to position 27; R at a position corresponding to position 27; R at a position corresponding to position 28; E at a position corresponding to position 29; I at a position corresponding to position 29; K at a position corresponding to position 29; L at a position corresponding to position 29; M at a position corresponding to position 29; P at a position corresponding to position 29; R at a position corresponding to position 29; S at a position corresponding to position 29; T at a position corresponding to position 29; V at a position corresponding to position 29; G at a position corresponding to position 30; H at a position corresponding to position 30; K at a position corresponding to position 30; L at a position corresponding to position 30; M at a position corresponding to position 30; R at a position corresponding to position 30; S at a position corresponding to position 30; A at a position corresponding to position 31; C at a position corresponding to position 31; G at a position corresponding to position 31; H at a position corresponding to position 31; I at a position corresponding to position 31; K at a position corresponding to position 31; L at a position corresponding to position 31; P at a position corresponding to position 31; R at a position corresponding to position 31; S at a position corresponding to position 31; T at a position corresponding to position 31; V at a position corresponding to position 31; W at a position corresponding to position 31; C at a position corresponding to position 32; F at a position corresponding to position 32; G at a position corresponding to position 32; H at a position corresponding to position 32; W at a position corresponding to position 33; G at a position corresponding to position 33; W at a position corresponding to position 34; Q at a position corresponding to position 35; V at a position corresponding to position 35; H at a position corresponding to position 36; N at a position corresponding to position 36; F at a position corresponding to position 37; M at a position corresponding to position 37; Y at a position corresponding to position 38; A at a position corresponding to position 39; L at a position corresponding to position 39; N at a position corresponding to position 39; T at a position corresponding to position 39; L at a position corresponding to position 40; T at a position corresponding to position 41; L at a position corresponding to position 46; R at a position corresponding to position 46; D at a position corresponding to position 47; F at a position corresponding to position 47; T at a position corresponding to position 47; W at a position corresponding to position 47, with F at a position corresponding to position 48; H at a position corresponding to position 48; K at a position corresponding to position 48; N at a position corresponding to position 48; R at a position corresponding to position 49; D at a position corresponding to position 50; S at a position corresponding to position 50; M at a position corresponding to position 50; N at a position corresponding to position 52; Q at a position corresponding to position 52; R at a position corresponding to position 52; S at a position corresponding to position 52; T at a position corresponding to position 52; C at a position corresponding to position 58; K at a position corresponding to position 58; L at a position corresponding to position 58; P at a position corresponding to position 58; Q at a position corresponding to position 58; R at a position corresponding to position 58; H at a position corresponding to position 58; N at a position corresponding to position 58; Y at a position corresponding to position 58; N at a position corresponding to position 59; K at a position corresponding to position 63; L at a position corresponding to position 63; M at a position corresponding to position 63; R at a position corresponding to position 63; W at a position corresponding to position 63; V at a position corresponding to position 67; H at a position corresponding to position 68; P at a position corresponding to position 68; Q at a position corresponding to position 68; A at a position corresponding to position 69; C at a position corresponding to position 69; E at a position corresponding to position 69; F at a position corresponding to position 69; G at a position corresponding to position 69; I at a position corresponding to position 69; L at a position corresponding to position 69;

M at a position corresponding to position 69; P at a position corresponding to position 69; R at a position corresponding to position 69; T at a position corresponding to position 69; W at a position corresponding to position 69; Y at a position corresponding to position 69; A at a position corresponding to position 70; C at a position corresponding to position 70; F at a position corresponding to position 70; G at a position corresponding to position 70; H at a position corresponding to position 70; K at a position corresponding to position 70; L at a position corresponding to position 70; N at a position corresponding to position 70; P at a position corresponding to position 70; R at a position corresponding to position 70; S at a position corresponding to position 70; T at a position corresponding to position 70; V at a position corresponding to position 70; Y at a position corresponding to position 70; G at a position corresponding to position 71; N at a position corresponding to position 71; R at a position corresponding to position 71; S at a position corresponding to position 71; K at a position corresponding to position 72; M at a position corresponding to position 72; Q at a position corresponding to position 72; A at a position corresponding to position 73; H at a position corresponding to position 73; K at a position corresponding to position 73; L at a position corresponding to position 73; Q at a position corresponding to position 73; R at a position corresponding to position 73; T at a position corresponding to position 73; W at a position corresponding to position 73; A at a position corresponding to position 74; C at a position corresponding to position 74; E at a position corresponding to position 74; F at a position corresponding to position 74; G at a position corresponding to position 74; H at a position corresponding to position 74; K at a position corresponding to position 74; L at a position corresponding to position 74; M at a position corresponding to position 74; N at a position corresponding to position 74; P at a position corresponding to position 74; R at a position corresponding to position 74; S at a position corresponding to position 74; V at a position corresponding to position 74; W at a position corresponding to position 74; F at a position corresponding to position 75; L at a position corresponding to position 75; M at position corresponding to position 75; R at a position corresponding to position 75; T at a position corresponding to position 75; L at a position corresponding to position 79; L at a position corresponding to position 82; N at a position corresponding to position 82; V at a position corresponding to position 83; Q at a position corresponding to position 83; S at a position corresponding to position 83; G at a position corresponding to position 83; E at a position corresponding to position 84; F at a position corresponding to position 84; G at a position corresponding to position 84; N at a position corresponding to position 84; R at a position corresponding to position 84; A at a position corresponding to position 86; H at a position corresponding to position 86; K at a position corresponding to position 86; N at a position corresponding to position 86; S at a position corresponding to position 86; T at a position corresponding to position 86; W at a position corresponding to position 86; C at a position corresponding to position 87; G at a position corresponding to position 87; L at a position corresponding to position 87; M at a position corresponding to position 87; R at a position corresponding to position 87; S at a position corresponding to position 87; T at a position corresponding to position 87; V at a position corresponding to position 87; Y at a position corresponding to position 87; C at a position corresponding to position 89; A at a position corresponding to position 90; E at a position corresponding to position 90; H at a position corresponding to position 90; K at a position corresponding to position 90; N at a position corresponding to position 90; R at a position corresponding to position 90; C at a position corresponding to position 92; L at a position corresponding to position 92; I at a position corresponding to position 93; L at a position corresponding to position 93; Q at a position corresponding to position 93; R at a position corresponding to position 93; S at a position corresponding to position 93; T at a position corresponding to position 93; D at a position corresponding to position 94; Q at a position corresponding to position 94; R at a position corresponding to position 94; A at a position corresponding to position 97; C at an amino acid residue corresponding to position 97; D at a position corresponding to position 97; E at a position corresponding to position 97; G at a position corresponding to position 97; L at a position corresponding to position 97; S at a position corresponding to position 97; S at a position corresponding to position 102; T at a position corresponding to position 102; R at a position corresponding to position 104; L at a position corresponding to position 107; A at a position corresponding to position 114; Q at a position corresponding to position 118; H at a position corresponding to position 120; F at a position corresponding to position 120; I at a position corresponding to position 120; S at a position corresponding to position 120; V at a position corresponding to position 120; Y at a position corresponding to position 120; E at a position corresponding to position 127; H at a position corresponding to position 127; N at a position corresponding to position 127; Q at a position corresponding to position 127; R at a position corresponding to position 127; I at a position corresponding to position 128; R at a position corresponding to position 130; G at a position corresponding to position 131; I at a position corresponding to position 131; M at a position corresponding to position 131; Q at a position corresponding to position 131; R at a position corresponding to position 131; V at a position corresponding to position 131; N at a position corresponding to position 132; L at a position corresponding to position 132; D at a position corresponding to position 135; G at a position corresponding to position 135; R at a position corresponding to position 135, with L at a position corresponding to position 138; T at a position corresponding to position 139; K at a position corresponding to position 140; H at a position corresponding to position 141; R at a position corresponding to position 141; S at a position corresponding to position 141; W at a position corresponding to position 141; Y at a position corresponding to position 141; D at a position corresponding to position 142; G at a position corresponding to position 142; K at a position corresponding to position 142; N at a position corresponding to position 142; P at a position corresponding to position 142; Q at a position corresponding to position 142; R at a position corresponding to position 142; S at a position corresponding to position 142; T at a position corresponding to position 142; G at a position corresponding to position 143; K at a position corresponding to position 143; R at a position corresponding to position 144; T at a position corresponding to position 144; P at a position corresponding to position 146; R at a position corresponding to position 146; A at a position corresponding to position 147; F at a position corresponding to position 147; L at a position corresponding to position 147; R at a position corresponding to position 147; S at a position corresponding to position 147; V at a position corresponding to position 147; H at a position corresponding to position 148; K at a position corresponding to position 148; Q at a position corresponding to position 148; T at a position corresponding to position 149; V at a position corresponding to position 149; A at a position corresponding to position 150; D at a position corresponding to position 150; G at a position corresponding to position 150; N at a position corresponding to position 150; S at a position corresponding to position 150; W at a position corresponding to position 150; Y at a position corresponding to position 150; A at a position corresponding to position 151; H at a position corresponding to position 151; K at a position corresponding to position 151; L at a position corresponding to position 151; M at a position corresponding to position 151; Q at a position corresponding to position 151; R at a position corresponding to position 151; S at a position corresponding to position 151; T at a position corresponding to position 151; V at a position corresponding to position 151; W at a position corresponding to position 151; Y at a position corresponding to position 151; R at a position corresponding to position 152; T at a position corresponding to position 152; W at a position corresponding to position 152; D at a position corresponding to position 155; G at a position corresponding to position 155; K at a position corresponding to position 155; R at a position corresponding to position 155; D at a position corresponding to position 156; Q at a position corresponding to position 158; S at a position corresponding to position 158; S at a position corresponding to position 160; E at a position corresponding to position 162; A at a position corresponding to position 163; E at a position corresponding to position 163; K at a position corresponding to position 163; Q at a position corresponding to position 163; R at a position corresponding to position 163; S at a position corresponding to position 163; M at a position corresponding to position 164; V at a position corresponding to position 164; D at a position corresponding to position 165; F at a position corresponding to position 165; N at a position corresponding to position 165; S at a position corresponding to position 165; V at a position corresponding to position 165; A at a position corresponding to position 166; E at a position corresponding to position 166; F at a position corresponding to position 166; H at a position corresponding to position 166; L at a position corresponding to position 166; Q at a position corresponding to position 166; R at a position corresponding to position 166; T at a position corresponding to position 166; W at a position corresponding to position 166; Y at a position corresponding to position 166; D at a position corresponding to position 167; L at a position corresponding to position 169; R at a position corresponding to position 170; A at a position corresponding to position 172; R at a position corresponding to position 173; G at a position corresponding to position 174; K at a position corresponding to position 174; N at a position corresponding to position 174; R at a position corresponding to position 174; T at a position corresponding to position 174; T at a position corresponding to position 175; K at a position corresponding to position 178; R at a position corresponding to position 178; K at a position corresponding to position 179; Q at a position corresponding to position 193; T at a position corresponding to position 195; N at a position corresponding to position 195; with E at a position corresponding to position 196; R at a position corresponding to position 196; with D at a position corresponding to position 198; P at a position corresponding to position 204; A at a position corresponding to position 205; E at a position corresponding to position 205; L at a position corresponding to position 205; T at a position corresponding to position 205; I at a position corresponding to position 206; K at a position corresponding to position 206; L at a position corresponding to position 206; R at a position corresponding to position 206; R at a position corresponding to position 209; N at a position corresponding to position 212; S at a position corresponding to position 212; A at a position corresponding to position 213; M at a position corresponding to position 213; N at a position corresponding to position 213; H at a position corresponding to position 215; M at a position corresponding to position 215; I at a position corresponding to position 219; K at a position corresponding to position 219; S at a position corresponding to position 219; H at a position corresponding to position 220; I at a position corresponding to position 220; L at a position corresponding to position 220; V at a position corresponding to position 220; Q at a position corresponding to position 221; G at a position corresponding to position 222; F at a position corresponding to position 232; G at a position corresponding to position 233; K at a position corresponding to position 233; R at a position corresponding to position 233; M at a position corresponding to position 234; A at a position corresponding to position 235; R at a position corresponding to position 236; C at a position corresponding to position 237; E at a position corresponding to position 237; H at a position corresponding to position 237; Q at a position corresponding to position 237; T at a position corresponding to position 237; E at a position corresponding to position 238; H at a position corresponding to amino acid position 238; S at a position corresponding to position 238; A at a position corresponding to position 240; Q at a position corresponding to position 240; I at a position corresponding to position 247; A at a position corresponding to position 248; V at a position corresponding to position 249; G at a position corresponding to position 257; T at a position corresponding to position 257; R at a position corresponding to position 257; N at a position corresponding to position 258; S at a position corresponding to position 258; P at a position corresponding to position 259; M at a position corresponding to position 260; Y at a position corresponding to position 260; A at a position corresponding to position 261; K at a position corresponding to position 261; N at a position corresponding to position 261; K at a position corresponding to position 263; R at a position corresponding to position 263; T at a position corresponding to position 267; A at a position corresponding to position 269; L at a position corresponding to position 271; M at a position corresponding to position 271; D at a position corresponding to position 272; T at a position corresponding to position 272; H at a position corresponding to position 273; Y at a position corresponding to position 273; F at a position corresponding to position 274; D at a position corresponding to position 276; H at a position corresponding to position 276; M at a position corresponding to position 276; R at a position corresponding to position 276; S at a position corresponding to position 276; Y at a position corresponding to position 276; A at a position corresponding to position 277; E at a position corresponding to position 277; H at a position corresponding to position 277; K at a position corresponding to position 277; M at a position corresponding to position 277; N at a position corresponding to position 277; Q at a position corresponding to position 277; R at a position corresponding to position 277; S at a position corresponding to position 277; T at a position corresponding to position 277; E at a position corresponding to position 278; F at a position corresponding to position 278; G at a position corresponding to position 278; H at a position corresponding to position 278; K at a position corresponding to position 278; N at a position corresponding to position 278; R at a position corresponding to position 278; S at a position corresponding to position 278; T at a position corresponding to position 278; Y at a position corresponding to position 278; H at a position corresponding to position 279; M at a position corresponding to position 282; S at a position corresponding to position 283; H at a position corresponding to position 285; T at a position corresponding to position 287; S at a position corresponding to position 289; S at a position corresponding to position 291; V at a position corresponding to position 291; C at a position corresponding to position 292; F at a position corresponding to position 292; H at a position corresponding to position 292; K at a position corresponding to position 292; R at a position corresponding to position 292; V at a position corresponding to position 292; A at a position corresponding to position 293; C at a position corresponding to position 293; D at a position corresponding to position 293; F at a position corresponding to position 293; K at a position corresponding to position 293; M at a position corresponding to position 293; P at a position corresponding to position 293; Q at a position corresponding to position 293; V at a position corresponding to position 293; Y at a position corresponding to position 293; G at a position corresponding to position 298; E at a position corresponding to position 305; G at a position corresponding to position 307; D at a position corresponding to position 308; G at a position corresponding to position 308; K at a position corresponding to position 308; N at a position corresponding to position 308; R at a position corresponding to position 308; E at a position corresponding to position 309; G at a position corresponding to position 309; H at a position corresponding to position 309; L at a position corresponding to position 309; M at a position corresponding to position 309; N at a position corresponding to position 309; Q at a position corresponding to position 309; R at a position corresponding to position 309; S at a position corresponding to position 309; T at a position corresponding to position 309; V at a position corresponding to position 309; A at a position corresponding to position 310; G at a position corresponding to position 310; Q at a position corresponding to position 310; S at a position corresponding to position 310; A at a position corresponding to position 313; G at a position corresponding to position 313; H at a position corresponding to position 313; K at a position corresponding to position 313; P at a position corresponding to position 313; R at a position corresponding to position 313; T at a position corresponding to position 313; Y at a position corresponding to position 313; with S at a position corresponding to position 314; Y at a position corresponding to position 314; A at a position corresponding to position 315; H at a position corresponding to position 315; Y at a position corresponding to position 315; A at a position corresponding to position 317; I at a position corresponding to position 317; K at a position corresponding to position 317; N at a position corresponding to position 317; Q at a position corresponding to position 317; R at a position corresponding to position 317; S at a position corresponding to position 317; T at a position corresponding to position 317; W at a position corresponding to position 317; D at a position corresponding to position 318; H at a position corresponding to position 318; K at a position corresponding to position 318; M at a position corresponding to position 318; R at a position corresponding to position 318; H at a position corresponding to position 320; K at a position corresponding to position 320; R at a position corresponding to position 320; R at a position corresponding to position 321; S at a position corresponding to position 321; N at a position corresponding to position 324; R at a position corresponding to position 324; A at a position corresponding to position 325; D at a position corresponding to position 325; E at a position corresponding to position 325; G at a position corresponding to position 325; H at a position corresponding to position 325; K at a position corresponding to position 325; M at a position corresponding to position 325; N at a position corresponding to position 325; Q at a position corresponding to position 325; S at a position corresponding to position 325; V at a position corresponding to position 325; L at a position corresponding to position 326; V at a position corresponding to position 326; C at a position corresponding to position 328; G at a position corresponding to position 328; I at a position corresponding to position 328; K at a position corresponding to position 328; L at a position corresponding to position 328; S at a position corresponding to position 328; Y at a position corresponding to position 328; S at a position corresponding to position 335; A at a position corresponding to position 347; G at a position corresponding to position 347; S at a position corresponding to position 347; M at a position corresponding to position 349; R at a position corresponding to position 349; S at a position corresponding to position 351; V at a position corresponding to position 353; with H at a position corresponding to position 356; S at a position corresponding to position 356; E at a position corresponding to position 359; H at a position corresponding to position 359; T at a position corresponding to position 359; A at a position corresponding to position 367; G at a position corresponding to position 367; K at a position corresponding to position 367; S at a position corresponding to position 367; A at a position corresponding to position 368; E at a position corresponding to position 368; K at a position corresponding to position 368; L at a position corresponding to amino acid position 368; M at a position corresponding to amino acid position 368; R at a position corresponding to position 368; T at a position corresponding to amino acid position 368; H at a position corresponding to position 369; R at a position corresponding to position 369; F at a position corresponding to position 371; H at a position corresponding to position 371; K at a position corresponding to position 371; L at a position corresponding to position 371; R at a position corresponding to position 371; S at a position corresponding to position 371; M at a position corresponding to position 373; H at a position corresponding to position 374; P at a position corresponding to position 374; A at a position corresponding to position 375; G at a position corresponding to position 375; K at a position corresponding to position 375; R at a position corresponding to position 375; D at a position corresponding to position 376; E at a position corresponding to position 376; Q at a position corresponding to position 376; R at a position corresponding to position 376; T at a position corresponding to position 376; V at a position corresponding to position 376; Y at a position corresponding to position 376; D at a position corresponding to position 377; E at a position corresponding to position 377; H at a position corresponding to position 377; K at a position corresponding to position 377; P at a position corresponding to position 377; R at a position corresponding to position 377; S at a position corresponding to position 377; T at a position corresponding to position 377; W at a position corresponding to position 380; Y at a position corresponding to position 380; S at a position corresponding to position 381; I at a position corresponding to position 383; K at a position corresponding to position 383; L at a position corresponding to position 383; S at a position corresponding to position 383; A at a position corresponding to position 385; Q at a position corresponding to position 385; V at a position corresponding to position 385; A at a position corresponding to position 389; G at a position corresponding to position 389; L at a position corresponding to position 389; K at a position corresponding to position 389; Q at a position corresponding to position 389; S at a position corresponding to position 389; A at a position corresponding to position 392; F at a position corresponding to position 392; M at a position corresponding to position 392; Q at a position corresponding to position 392; R at a position corresponding to position 392; V at a position corresponding to position 392; F at a position corresponding to position 393; M at a position corresponding to position 393; A at a position corresponding to position 395; H at a position corresponding to position 395; R at a position corresponding to position 395; A at a position corresponding to position 396; H at a position corresponding to position 396; Q at a position corresponding to position 396; S at a position corresponding to position 396; K at a position corresponding to position 399; M at a position corresponding to position 399; T at a position corresponding to position 399; V at a position corresponding to position 399; W at a position corresponding to position 399; A at a position corresponding to position 401; E at a position corresponding to position 401; A at a position corresponding to position 404; G at a position corresponding to position 405; F at a position corresponding to position 406; N at a position corresponding to position 406; A at a position corresponding to position 407; D at a position corresponding to position 407; E at a position corresponding to position 407; F at a position corresponding to position 407; H at a position corresponding to position 407; Q at a position corresponding to position 407; P at a position corresponding to position 407; A at a position corresponding to position 409; Q at a position corresponding to position 409; T at a position corresponding to position 410; Q at a position corresponding to position 412; R at a position corresponding to position 412; V at a position corresponding to position 412; L at a position corresponding to position 416; E at a position corresponding to position 418; L at a position corresponding to position 418; P at a position corresponding to position 418; R at a position corresponding to position 418; V at a position corresponding to position 418; F at a position corresponding to position 419; H at a position corresponding to position 419; I at a position corresponding to position 419; K at a position corresponding to position 419; R at a position corresponding to position 419; S at a position corresponding to position 419; Y at a position corresponding to position 419; A at a position corresponding to position 421; H at a position corresponding to position 421; K at a position corresponding to position 421; N at a position corresponding to position 421; Q at a position corresponding to position 421; R at a position corresponding to position 421; S at a position corresponding to position 421; G at a position corresponding to position 425; K at a position corresponding to position 425; Q at a position corresponding to position 427; T at a position corresponding to position 427; L at a position corresponding to position 428; A at a position corresponding to position 431; G at a position corresponding to position 431; E at a position corresponding to position 431; H at a position corresponding to position 431; K at a position corresponding to position 431; L at a position corresponding to position 431; N at a position corresponding to position 431; Q at a position corresponding to position 431; R at a position corresponding to position 431; S at a position corresponding to position 431; V at a position corresponding to position 431; A at a position corresponding to position 433; H at a position corresponding to position 433; I at a position corresponding to position 433; K at a position corresponding to position 433; L at a position corresponding to position 433; R at a position corresponding to position 433; T at a position corresponding to position 433; V at a position corresponding to position 433; W at a position corresponding to position 433; K at a position corresponding to position 436; I at a position corresponding to position 437; M at a position corresponding to position 437; A at a position corresponding to position 438; D at a position corresponding to position 438; E at a position corresponding to position 438; L at a position corresponding to position 438; N at a position corresponding to position 438; T at a position corresponding to position 438; A at a position corresponding to position 439; C at a position corresponding to position 439; K at a position corresponding to position 439; P at a position corresponding to position 439; Q at a position corresponding to position 439; T at a position corresponding to position 439; V at a position corresponding to position 439; D at a position corresponding to position 440; H at a position corresponding to position 440; M at a position corresponding to position 440; P at a position corresponding to position 440; R at a position corresponding to position 440; S at a position corresponding to position 440; A at a position corresponding to position 441; F at a position corresponding to position 441; C at a position corresponding to position 442; G at a position corresponding to position 442; R at a position corresponding to position 442; A at a position corresponding to position 443; E at a position corresponding to position 443; F at a position corresponding to position 443; G at a position corresponding to position 443; M at a position corresponding to position 443; N at a position corresponding to position 443; E at a position corresponding to position 444; H at a position corresponding to position 444; V at a position corresponding to position 444; H at a position corresponding to position 445; M at a position corresponding to position 445; N at a position corresponding to position 445; P at a position corresponding to position 445; Q at a position corresponding to position 445; S at a position corresponding to position 445; T at a position corresponding to position 445; V at a position corresponding to position 445; W at a position corresponding to position 445; A at a position corresponding to position 446; M at a position corresponding to position 446; W at a position corresponding to position 446; D at a position corresponding to position 447; E at a position corresponding to position 447; G at a position corresponding to position 447; I at a position corresponding to position 447; N at a position corresponding to position 447; P at a position corresponding to position 447; Q at a position corresponding to position 447; T at a position corresponding to position 447, and/or replacement with V at a position corresponding to position 447, each with reference to amino acid positions set forth in SEQ ID NO:3. Among these modified PH20 polypeptides are those that exhibit at least 40% of the activity of the PH20 that does not contain the particular amino acid replacement. Activity can vary between, for example, 40% to 5000%, 40% to 2000%, 40% to 1000%, 40% to 500%, 40% to 100%, 80% to 2000%, 80% to 600%, 80% to 200%, 80% to 300%, of the hyaluronidase activity of the PH20 polypeptide not containing the amino acid replacement. Such activity includes at least 50%, 60%, 70%, 80%, 90%, 100%, 120%, 130%, 140%, 150%, 160%, 170%, 180%, 190%, 200%, 300%, 400%, 500%, 600%, 700%, 800%, 900%, 1000%, 2000%, 3000% or more of the hyaluronidase activity of the PH20 polypeptide not containing the amino acid replacement, where, as in all instances herein, the activities are compared under the same conditions.

In particular, provided are modified PH20 polypeptides that contain at least one amino acid replacement in a PH20 polypeptide set forth in SEQ ID NO:7, a C-terminally truncated fragment thereof, or in a PH20 polypeptide that has a sequence of amino acids that is at least 91% identical to the sequence of amino acids set forth in SEQ ID NO: 7 or a corresponding truncated fragment, where: the modified PH20 polypeptides exhibit less than 20% of the hyaluronidase activity of the PH20 polypeptide not containing the amino acid replacement, where activities are compared under the same conditions; the amino acid replacement(s) is at an amino acid position corresponding to a position selected from among 2, 3, 4, 5, 6, 7, 8, 9, 10, 11, 12, 13, 14, 15, 16, 17, 18, 19, 20, 21, 22, 23, 25, 27, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 94, 95, 96, 98, 99, 100, 101, 102, 103, 104, 105, 106, 107, 108, 109, 110, 111, 112, 113, 114, 115, 116, 117, 118, 119, 121, 122, 123, 124, 125, 126, 127, 128, 129, 130, 131, 132, 133, 134, 135, 136, 137, 138, 139, 143, 144, 145, 149, 150, 152, 153, 154, 155, 156, 157, 158, 159, 161, 163, 164, 165, 166, 167, 168, 169, 170, 171, 172, 173, 174, 175, 176, 178, 179, 180, 181, 182, 183, 184, 185, 186, 187, 188, 189, 190, 191, 192, 193, 194, 195, 197, 198, 199, 200, 201, 202, 203, 204, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 238, 239, 240, 241, 242, 243, 244, 245, 246, 247, 248, 249, 250, 251, 252, 253, 254, 255, 256, 257, 258, 260, 261, 262, 263, 264, 265, 266, 267, 268, 269, 270, 271, 272, 273, 274, 275, 276, 278, 279, 280, 282, 283, 284, 285, 286, 287, 288, 289, 290; 291, 292, 293, 294, 295, 296, 297, 298, 299, 300, 301, 302, 303, 304, 305, 306, 307, 308, 310, 311, 312, 313, 314, 315, 316, 317, 318, 319, 320, 321, 322, 323, 324, 325, 326, 327, 331, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 408, 410, 411, 412, 413, 414, 415, 416, 417, 419, 420, 422, 423, 424, 425, 426, 427, 428, 429, 430, 431, 432, 434, 437, 438, 439, 440, 441, 442, 443, 444, or 447 with reference to amino acid positions set forth in SEQ ID NO:3 or 7; corresponding amino acid positions are identified by alignment of the PH20 polypeptide with the polypeptide set forth in SEQ ID NO:3; and provided that:

(i) if the modified PH20 polypeptide contains an amino acid replacement at a position corresponding to position 200, 333, 358 or 393 the replacement is not replacement with an Alanine (A).

(ii) if the modified PH20 polypeptide contains an amino acid replacement at a position corresponding to position 111 or 249 the replacement is not replacement with an asparagine (N);

(iii) if the modified PH20 polypeptide contains an amino acid replacement at a position corresponding to position 113 the replacement is not replacement with a glutamine (Q);

(iv) if the modified PH20 polypeptide contains an amino acid replacement at a position corresponding to position 176 the replacement is not replacement with a glycine (G); and (v) if the modified PH20 polypeptide contains an amino acid replacement at a position corresponding to position 252 the replacement is not replacement with a threonine (T).

Exemplary of such modified PH20 polypeptides are any that contain amino acid replacement(s) in a PH20 polypeptide that has the sequence of amino acids set forth in any of SEQ ID NOS: 3, 7, 32-66, 69, or 72, or in a sequence of amino acids that exhibits at least 91% sequence identity to any of SEQ ID NOS: 3, 7, 32-66, 69, or 72. For example, the modified PH20 polypeptide contains amino acid replacement(s) in SEQ ID NOS: 3, 7, 32-66, 69, or 72, which are polypeptides that are a C-terminally truncated fragment of SEQ ID NO:7, or a PH20 polypeptide that has a sequence of amino acids that is at least 91% identical to the sequence of amino acids set forth in SEQ ID NO:7. In examples of such modified PH20 polypeptides provided herein, the modified PH20 polypeptides can exhibit similar or the same activity as the PH20 without the modification, or can exhibit increased activity or activity that is less than 15%, 10%, 9%, 8%, 7%, 6%, 5%, 4%, 3%, 2%, 1%, 0.9%, 0.8%, 0.7%, 0.6%, 0.5%, 0.4%, 0.3%, 0.2%, 0.1%, 0.05% or less of the hyaluronidase activity of the PH20 polypeptide not containing the amino acid replacement. Exemplary of such modified PH20 polypeptides are any set forth in Table 5.

Among any and all of the modified PH20 polypeptides provided herein and above, the modified PH20 polypeptide is one that does not consist of the sequence of amino acids set forth in any of SEQ ID NOS: 3, 6-66, 69-72, 856-861, 869 or 870. In particular, among any of the modified PH20 polypeptides provided herein above or elsewhere herein are any that contain an amino acid replacement(s) in a PH20 polypeptide having the sequence of amino acids set forth any of SEQ ID NO: 3, 7, 69 or 72 provided that: (i) where the modified PH20 polypeptide includes only a single amino acid replacement the replacement does not corresponds to amino acid replacements V12A, N47A, D111N, E113Q, N131A, R176G, N200A, N219A, E249Q, R252T, N333A or N358A, with reference to amino acid positions set forth in SEQ ID NO:3; (ii) where the modified PH20 polypeptide includes only two amino acid replacements the replacements do not correspond to amino acid replacements P13A/L464W, N47A/N131A, N47A/N219A, N131A/N219A or N333A/N358A with reference to positions set forth in SEQ ID NO:3; and (iii) where the modified PH20 polypeptide includes only three amino acid replacements the replacements do not correspond to amino acid replacements N47A/N131A/N219A, with reference to amino acid positions set forth in SEQ ID NO:3.

Any of the above modified PH20 polypeptides and any provided herein and described above and below can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, or more of the amino acid replacements. The modified PH20 polypeptides can include a signal sequence, including the native sequence or a heterologous sequence or a modified sequence, and also include a mature PH20 polypeptide that lacks the signal sequence.

Among any of the modified PH20 polypeptides provided herein above or described below are modified PH20 polypeptides that contain or have the sequence of amino acids set forth in any of SEQ ID NOS: 73-855 or a sequence of amino acids that exhibits at least 75%, 80%, 90%, 91%, 92%, 93%, 94%, 95%, 96%, 97%, 98%, 99% or more sequence identity to a sequence of amino acids set forth in any of SEQ ID NOS: 73-855 and that contains at least one amino acid replacement, such as any described above or elsewhere herein, with reference to positions compared to the sequence of amino acids set forth in SEQ ID NO:3. In any of the examples of the modified PH20 polypeptides provided herein, the modified PH20 polypeptide does not have or contain the sequence of amino acids set forth in any of SEQ ID NOS: 8-31, 69-72, 856-861, 869 or 870.

The modified PH20 polypeptides provided herein can be substantially purified or isolated, can exhibit catalytic activity at neutral pH, can be secreted upon expression from cells and are soluble in the supernatant, and/or can include modified amino acids, such as a modification selected from among glycosylation, sialation, albumination, farnysylation, carboxylation, hydroxylation, conjugation to a polymer, such as PEGylation or conjugation to dextran, conjugation to another moiety, such as a multimerization domain, toxin, detectable label or drug, and phosphorylation. The modified PH20 polypeptide can be glycosylated, such as by containing at least an N-acetylglucosamine moiety linked to each of at least three asparagine (N) residues, where, for example, the three asparagine residues correspond to amino acid residues 200, 333 and 358 of SEQ ID NO:3. Multimerization domains include Fc domains.

Also provided are nucleic acid molecules that encode any of the modified PH20 polypeptides provided herein. Vectors, eukaryotic and prokaryotic, that contain the nucleic acid molecules are provided. The vectors include expression vectors and include mammalian vectors, including viral vectors. Viral vectors include adenovirus vectors, retrovirus vectors, vaccinia virus vectors, herpes simplex virus and cytomegalovirus vectors, and other such viral vectors. Of interest are oncolytic vectors that accumulate in or are targeted to tumors. Also provided are cells that contain the nucleic acid molecules and cells that contain the vectors. The cells can be prokaryotic or eukaryotic, particularly mammalian cells, such as Chinese Hamster Ovary (CHO) cells.

Also provided herein is a modified PH20 polypeptide that is produced by any of the provided cells. Thus, provided herein are methods of producing a modified PH20 polypeptide by culturing any of the cells provided herein under conditions whereby an encoded modified PH20 polypeptide is produced and secreted by the cell, and recovering the expressed polypeptide. Also provided herein is a method of producing a modified PH20 polypeptide by introducing any of the nucleic acids provided herein or any of the vectors provided herein into a cell capable of incorporating N-linked sugar moieties into the polypeptide, culturing the cell under conditions whereby an encoded modified PH20 polypeptide is produced and secreted by the cell, and recovering the expressed polypeptide. In such examples, the nucleic acid is operably linked to a promoter. The cultured cell can be a eukaryotic cell, such as a mammalian cell, for example, a Chinese hamster ovary (CHO) cell.

Also provided are pharmaceutical compositions that contain any of the modified PH20 polypeptides provided herein or any of the nucleic acids or vectors provided herein. The compositions can be formulated with other agents and/or with other components, such as preservatives. The compositions can be formulated so that the components, particularly the PH20 and any other active agent, remain active or are stable under preselected conditions. In addition, as described herein, the PH20 polypeptides are modified so that they exhibit increased stability under various conditions. For example, provided are compositions in which the modified PH20 polypeptide is stable (i.e., retains activity as described herein) at a temperature from or from about 2° C. to 8° C., inclusive, for at least 1 month or is stable at a temperature from or from about 30° C. to 42° C., inclusive, for at least 3 days. Provided are compositions in which the modified PH20 polypeptide in the composition is stable at a temperature from or from about 2° C. to 8° C., inclusive, for at least 2 months, 3 months, 4 months, 5 months, 6 months, 7 months, at least 8 months, at least 9 months, at least 10 months, at least 11 months, at least 12 months, 13 months, 14 months, 15 months, 16 months, 17 months, 18 months, 19 months, 20 months, 21 months, 22 months, 23 months, 24 months, months, 26 months, 27 months, 28 months, 29 months or 30 months. Also provided are compositions in which the modified PH20 polypeptide in the composition is stable at a temperature from or from about 30° C. to 42° C., inclusive, for at least 3 days, at least 4 days, 5 days, 6 days, 7 days, 8 days, 9 days, 10 days, 11 days, 12 days, 13 days, 14 days, 15 days, 20 days, 21 days, 22 days, 23 days, 24 days, 25 days, 26 days, 27 days, 28 days, 29 days, days, 35 days, 40 days, 45 days, 50 days, 60 days or more. The pharmaceutical compositions can contain a pharmaceutically acceptable excipient.

The conditions, formulations, components, and modified PH20 polypeptide are chosen to achieve a desired stability. The pharmaceutical compositions can be formulated for direct administration or can require dilution. They can be formulated for multiple or single dosage administration. Exemplary compositions include concentrations of modified PH20 between or about between 0.1 µg/mL to 100 µg/mL, 1 µg/mL to 50 µg/mL or 1 µg/mL to 20 µg/mL, or 10 U/mL to 5000 U/mL, 50 U/mL to 4000 U/mL, 100 U/mL to 2000 U/mL, 300 U/mL to 2000 U/mL, 600 U/mL to 2000 U/mL, or 100 U/mL to 1000 U/mL. Exemplary salts include NaCl at a concentration, for example, of less than or about or 200 mM, 180 mM, 150 mM, 140 mM, 130 mM, 120 mM, 110 mM, 100 mM, 90 mM, 80 mM, 70 mM, 60 mM, 50 mM, 40 mM, 30 mM, 25 mM, 20 mM, 15 mM, 10 mM, 5 mM or less, or between or about between 0.1 mM to 200 mM, 0.1 mM to 100 mM, 120 mM to 200 mM, 10 mM to 50 mM, 10 mM to 90 mM, 80 mM to 200 mM, 80 mM to 140 mM, 50 mM to 100 mM, 80 mM to 100 mM, 50 mM to 80 mM, 100 mM to 140 mM or 120 mM to 140 mM.

The pharmaceutical compositions can contain an antimicrobially effective amount of a preservative or mixture of preservatives, such as one, two, three, four or more of a phenolic preservative(s), a non-phenolic preservative(s) or a phenolic preservative(s) and a non-phenolic preservative(s), such as, but not limited to, phenol, m-cresol, methylparaben, benzyl alcohol, thimerosal, benzalkonium chloride, 4-chloro-1-butanol, chlorhexidine dihydrochloride, chlorhexidine digluconate, L-phenylalanine, EDTA, bronopol, phenylmercuric acetate, glycerol, imidurea, chlorhexidine, sodium dehydroacetate, o-cresol, p-cresol, chlorocresol, cetrimide, benzethonium chloride, ethyl paraben, propylparaben, butylparaben and any combinations thereof. Phenols include, for example, phenol, metacresol (m-cresol), benzyl alcohol, and parabens, such as methylparaben or propylparaben. Anti-microbial effective concentrations of one or more preservative agents (as a percentage (%) of mass concentration (w/v)) can be between 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4% inclusive. Examples thereof are pharmaceutical compositions where the preservatives are phenol, m-cresol or phenol and m-cresol and the amount as a % of mass concentration (w/v) in the formulation is between or about between 0.1% to 0.25% phenol and between or about between 0.05% to 0.2% m-cresol, is between or about between 0.10% to 0.2% phenol and between or about between 0.6% to 01.8% m-cresol, between or about between 0.1% to 0.15% phenol and 0.8% t 0.15% m-cresol, is between or about between 0.10% to 0.15% phenol and between or about between 0.06 to 0.09% m-cresol or is between or about between 0.12% to 0.18% phenol and between or about between 0.14 to 0.22% m-cresol.

The pharmaceutical compositions can contain a further therapeutically active agent. The active agent can be formulated in the composition or provided as a combination with the PH20-containing composition, but in a separate composition for administration separately, sequentially, intermittently, simultaneously or together. Therapeutically active agents include, for example, an agent selected from among a chemotherapeutic agent, an analgesic agent, an anti-inflammatory agent, an antimicrobial agent, an amoebicidal agent, a trichomonacidal agent, an anti-parkinson agent, an anti-malarial agent, an anticonvulsant agent, an anti-depressant agent, and antiarthritics agent, an anti-fungal agent, an antihypertensive agent, an antipyretic agent, an anti-parasite agent, an antihistamine agent, an alpha-adrenergic agonist agent, an alpha blocker agent, an anesthetic agent, a bronchial dilator agent, a biocide agent, a bactericide agent, a bacteriostat agent, a beta adrenergic blocker agent, a calcium channel blocker agent, a cardiovascular drug agent, a contraceptive agent, a decongestant agent, a diuretic agent, a depressant agent, a diagnostic agent, a electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sympathomimetic agent, a tranquilizer agent, an urinary agent, a vaginal agent, a viricide agent, a vitamin agent, a non-steroidal anti-inflammatory agent, an angiotensin converting enzyme inhibitor agent, a polypeptide, a protein, a nucleic acid, a drug, an organic molecule and a sleep inducer. Exemplary of such agents are antibodies, particularly monoclonal antibodies, an Immune Globulin preparation, a bisphosphonate, a cytokine, a chemotherapeutic agent, a coagulation factor and an insulin. Insulins include, for example, basal insulins and fast-acting insulin, such as regular insulin, particularly recombinant human insulin, and insulin analogs, such as insulin lispro, insulin aspart or insulin glulisine. Particular fast-acting insulins are those with an A chain having a sequence of amino acids set forth in SEQ ID NO:862 and a B chain having a sequence of amino acids set forth in SEQ ID NO:863 or an insulin with an A chain with a sequence of amino acids set forth as amino acid residue positions 88-108 of SEQ ID NO:864 and a B chain with a sequence of amino acids set forth as amino acid residue positions 25-54 of SEQ ID NO:864 or an insulin analog that is selected from among an insulin having an A chain with a sequence of amino acids set forth in SEQ ID NO:862 and a B chain having a sequence of amino acids set forth in any of SEQ NOS:865-867. The amount of fast-acting insulin in the compositions can be empirically determined, but typically can be 10 U/mL to 1000 U/mL, 50 U/mL to 500 U/mL, 100 U/mL to 1000 U/mL or 500 U/mL to 1000 U/mL, inclusive.

In particular examples, provided herein is a pharmaceutical composition containing any of the modified PH20 polypeptides provided herein that exhibit increased stability to a phenolic preservative and an insulin, such as a fast-acting insulin. The modified PH20 polypeptides and insulin can be provided in therapeutically effective amounts. For example, provided herein is a pharmaceutical composition that contains any of the modified PH20 polypeptides provided herein that exhibits increased stability to a phenolic preservative in an amount that is from or from about 100 U/mL to 1000 U/mL and a fast-acting insulin in an amount that is from or from about 10 U/mL to 1000 U/mL. For example, the fast-acting insulin can be an insulin analog, such as insulin lispro, insulin aspart or insulin glulisine or other analog. Any of such pharmaceutical compositions can be formulated at a pH that is from or from about 7.0 to 7.6. Any of such pharmaceutical compositions also can be formulated to contain salt, such as NaCl, at a concentration that is from or from about 0.1 mM to 200 mM and/or an anti-microbial effective amount of at least one preservative where the composition generally contains at least one phenolic preservative. The anti-microbial effective amount is a total amount of one or more preservative agents as a percentage (%) of mass concentration (w/v) that is or is between 0.05% to 0.6%. The phenolic preservative(s) can be a phenol, metacresol (m-cresol), benzyl alcohol, or a paraben. In any of the above examples of a pharmaceutical composition, the composition also can contain a surfactant, such as a polypropylene glycol, polyethylene glycol, glycerin, sorbitol, poloxamer or polysorbate, in an amount as a % of mass concentration (w/v) in the formulation that is at least or at least about 0.001%; a buffering agent that is a non-metal binding agent or is a metal binding agent, such as Tris, histidine, phosphate or citrate, wherein the concentration of the buffering agent is between or between about 1 mM to 100 mM; glycerin in a concentration less than 60 mM; an antioxidant, such as cysteine, tryptophan or methionine, at a concentration between or from about between 2 mM to 50 mM, inclusive; and/or zinc at a concentration of between or about between 0.001 to 0.1 mg per 100 units of insulin (mg/100U). Also provided herein are closed loop systems, insulin pumps including continuous subcutaneous infusion insulin (CSII) pumps and insulin pens that contain any of the pharmaceutical compositions. The pharmaceutical compositions can be used in methods or uses for treating diabetes, such as type 1 diabetes mellitus, type 2 diabetes mellitus or gestational diabetes.

Other therapeutic agents in any of the pharmaceutical compositions provided herein include, but are not limited to Adalimumabs, Agalsidase Betas, Alefacepts, Ampicillins, Anakinras, Antipoliomyelitic Vaccines, Anti-Thymocytes, Azithromycins, Becaplermins, Caspofungins, Cefazolins, Cefepimes, Cefotetans, Ceftazidimes, Ceftriaxones, Cetuximabs, Cilastatins, Clavulanic Acids, Clindamycins, Darbepoetin Alfas, Daclizumabs, Diphtheria, Diphtheria antitoxins, Diphtheria Toxoids, Efalizumabs, Epinephrines, Erythropoietin Alphas, Etanercepts, Filgrastims, Fluconazoles, Follicle-Stimulating Hormones, Follitropin Alphas, Follitropin Betas, Fosphenyloins, Gadodiamides, Gadopentetates, Gatifloxacins, Glatiramers, GM-CSF's, Goserelins, Goserelin acetates, Granisetrons, *Haemophilus Influenza* B's, Haloperidols, Hepatitis vaccines, Hepatitis A Vaccines, Hepatitis B Vaccines, Ibritumomab Tiuxetans, Ibritumomabs, Tiuxetans, Immunoglobulins, *Hemophilus influenza* vaccines, Influenza Virus Vaccines, Infliximabs, Insulin lispro, 75% neutral protamine lispro (NPL)/25% insulin lispro, 50% neutral protamine Hagedorn (NPH)/50% regular insulin, 70% NPH/30% regular insulin; Regular insulin, NPH insulin, Ultra insulin, Ultralente insulin, and Insulin Glargines, Interferons, Interferon alpha, Interferon Betas, Interferon Gammas, Interferon alpha-2a, Interferon alpha 2-b, Interferon Alphacon, Interferon alpha-n, Interferon Betas, Interferon Beta-1a's, Interferon Gammas, Interferon alpha-con, Iodixanols, Iohexyls, Iopamidols, Ioversols, Ketorolacs, Laronidases, Levofloxacins, Lidocaines, Linezolids, Lorazepams, Measles Vaccines, Measles virus, Mumps viruses, Measles-Mumps-Rubella Virus Vaccines, Rubella vaccines, Medroxyprogesterones, Meropenems, Methylprednisolones, Midazolams, Morphines, Octreotides, Omalizumabs, Ondansetrons, Palivizumabs, Pantoprazoles, Pegaspargases, Pegfilgrastims, Peg-Interferon Alpha-2a's, Peg-Interferon Alpha-2b's, Pegvisomants, Pertussis vaccines, Piperacillins, Pneumococcal Vaccines and Pneumococcal Conjugate Vaccines, Promethazines, Reteplases, Somatropins, Sulbactams, Sumatriptans, Tazobactams, Tenecteplases, Tetanus Purified Toxoids, Ticarcillins, Tositumomabs, Triamcinolones, Triamcinolone Acetonides, Triamcinolone hexacetonides, Vancomycins, Varicella Zoster immunoglobulins, Varicella vaccines, other vaccines, Alemtuzumabs, Alitretinoins, Allopurinols, Altretamines, Amifostines, Anastrozoles, Arsenics, Arsenic Trioxides, Asparaginases, *Bacillus* Calmette-Guerin (BCG) vaccines, BCG Live, Bexarotenes, Bleomycins, Busulfans, Busulfan intravenous, Busulfan orals, Calusterones, Capecitabines, Carboplatins, Carmustines, Carmustines with Polifeprosans, Celecoxibs, Chlorambucils, Cisplatins, Cladribines, Cyclophosphamides, Cytarabines, Cytarabine liposomals, Dacarbazines, Dactinomycins, Daunorubicin liposomals, Daunorubicins, Daunomycins, Denileukin Diftitoxes, Dexrazoxanes, Docetaxels, Doxorubicins, Doxorubicin liposomals, Dromostanolone propionates, Elliott's B Solutions, Epirubicins, Epoetin alfas, Estramustines, Etoposides, Etoposide phosphates, Etoposide VP-16s, Exemestanes, Floxuridines, Fludarabines, Fluorouracils, 5-Fluorouracils, Fulvestrants, Gemcitabines, Gemtuzumabs, Ozogamicins, Gemtuzumab ozogamicins, Hydroxyureas, Idarubicins, Ifosfamides, Imatinib mesylates, Irinotecans, Letrozoles, Leucovorins, Levamisoles, Lomustines, CCNUs, Mechlorethamines, Nitrogen mustards, Megestrols, Megestrol acetates, Melphalans, L-PAMs, Mercaptopurines, 6-Mercaptopurines, Mesnas, Methotrexates, Methoxsalens, Mitomycins, Mitomycin C's, Mitotanes, Mitoxantrones, Nandrolones, Nandrolone Phenpropionates, Nofetumomabs, Oprelvekins, Oxaliplatins, Paclitaxels, Pamidronates, Pegademases, Pentostatins, Pipobromans, Plicamycins, Mithramycins, Porfimers, Porfimer sodiums, Procarbazines, Quinacrines, Rasburicases, Rituximabs, Sargramostims, Streptozocins, Talcs, Tamoxifens, Temozolomides, Teniposides, Testolactones, Thioguanines, 6-Thioguanines, Triethylenethiophosphoramides (Thiotepas), Topotecans, Toremifenes, Trastuzumabs, Tretinoins, Uracil Mustards, Valrubicins, Vinblastines, Vincristines, Vinorelbines, Zoledronates, Acivicins, Aclarubicins, Acodazoles, Acronines, Adozelesins, Aldesleukins, Retinoic Acids, Alitretinoins, 9-Cis-Retinoic Acids, Alvocidibs, Ambazones, Ambomycins, Ametantrones, Aminoglutethimides, Amsacrines, Anaxirones, Ancitabines, Anthramycins, Apaziquones, Argimesnas, Asperlins, Atrimustines, Azacitidines, Azetepas, Azotomycins, Banoxantrones, Batabulins, Batimastats, Benaxibines, Bendamustines, Benzodepas, Bicalutamides, Bietaserpines, Biricodars, Bisantrenes, Bisnafide Dimesylates, Bizelesins, Bortezomibs, Brequinars, Bropirimines, Budotitanes, Cactinomycins, Canertinibs, Caracemides, Carbetimers, Carboquones, Carmofurs, Carubicins, Carzelesins, Cedefingols, Cemadotins, Chlorambucils, Cioteronels, Cirolemycins, Clanfenurs, Clofarabines, Crisnatols, Decitabines, Dexniguldipines, Dexormaplatins, Dezaguanines, Diaziquones, Dibrospidiums, Dienogests, Dinalins, Disermolides, Dofequidars, Doxifluridines, Droloxifenes, Duazomycins, Ecomustines, Edatrexates, Edotecarins, Eflornithines, Elacridars, Elinafides, Elsamitrucins, Emitefurs, Enloplatins, Enpromates, Enzastaurins, Epipropidines, Eptaloprosts, Erbulozoles, Esorubicins, Etanidazoles, Etoglucids, Etoprines, Exisulinds, Fadrozoles, Fazarabines, Fenretinides, Fluoxymesterones, Fluorocitabines, Fosquidones, Fostriecins, Fotretamines, Galarubicins, Galocitabines, Geroquinols, Gimatecans, Gimeracils, Gloxazones, Glufosfamides, Ilmofosines, Ilomastats, Imexons, Improsulfans, Indisulams, Inproquones, Interleukins, Interleukin-2s, recombinant Interleukins, Intoplicines, Iobenguanes, Iproplatins, Irsogladines, Ixabepilones, Ketotrexates, L-Alanosines, Lanreotides, Lapatinibs, Ledoxantrones, Leuprolides, Leuprorelins, Lexacalcitols, Liarozoles, Lobaplatins, Lometrexols, Lonafarnibs, Losoxantrones, Lurtotecans, Mafosfamides, Mannosulfans, Marimastats, Masoprocols, Maytansines, Mechlorethamines, Melengestrols, Melphalans, Menogarils, Mepitiostanes, Metesinds, Metomidates, Metoprines, Meturedepas, Miboplatins, Miproxifenes, Misonidazoles, Mitindomides, Mitocarcins, Mitocromins, Mitoflaxones, Mitogillins, Mitoguazones, Mitomalcins, Mitonafides, Mitoquidones, Mitospers, Mitozolomides, Mivobulins, Mizoribines, Mofarotenes, Mopidamols, Mubritinibs, Mycophenolic Acids, Nedaplatins, Neizarabines, Nemorubicins, Nitracrines, Nocodazoles, Nogalamycins, Nolatrexeds, Nortopixantrones, Ormaplatins, Ortataxels, Oteracils, Oxisurans, Oxophenarsines, Patupilones, Peldesines, Peliomycins, Pelitrexols, Pemetrexeds, Pentamustines, Peplomycins, Perfosfamides, Perifosines, Picoplatins, Pinafides, Piposulfans, Pirfenidones, Piroxantrones, Pixantrones, Plevitrexeds, Plomestanes, Porfiromycins, Prednimustines, Propamidines, Prospidiums, Pumitepas, Puromycins, Pyrazofurins, Ranimustines, Riboprines, Ritrosulfans, Rogletimides, Roquinimexs, Rufocromomycins, Sabarubicins, Safingols, Satraplatins, Sebriplatins, Semustines, Simtrazenes, Sizofirans, Sobuzoxanes, Sorafenibs, Sparfosates, Sparfosic Acids, Sparsomycins, Spirogermaniums, Spiromustines, Spiroplatins, Squalamines, Streptonigrins, Streptovarycins, Sufosfamides, Sulofenurs, Tacedinalines, Talisomycins, Tallimustines, Tariquidars, Tauromustines, Tecogalans, Tegafurs, Teloxantrones, Temoporfins, Teroxirones, Thiamiprines, Tiamiprines, Tiazofurins, Tilomisoles, Tilorones, Timcodars, Timonacics, Tirapazamines, Topixantrones, Trabectedins, Ecteinascidin 743, Trestolones, Triciribines, Trilostanes, Trimetrexates, Triplatin Tetranitrates, Triptorelins, Trofosfamides, Tubulozoles, Ubenimexs, Uredepas, Valspodars, Vapreotides, Verteporfins, Vinblastines, Vindesines, Vinepidines, Vinflunines, Vinformides, Vinglycinates, Vinleucinols, Vinleurosines, Vinrosidines, Vintriptols, Vinzolidines, Vorozoles, Xanthomycin A's, Guamecyclines, Zeniplatins, Zilascorbs [2-H], Zinostatins, Zorubicins, Zosuquidars, Acetazolamides, Acyclovirs, Adipiodones, Alatrofloxacins, Alfentanils, Allergenic extracts, Alpha 1-proteinase inhibitors, Alprostadils, Amikacins, Amino acids, Aminocaproic acids, Aminophyllines, Amitriptylines, Amobarbitals, Amrinones, Analgesics, Anti-poliomyelitic vaccines, Anti-rabic serums, Anti-tetanus immunoglobulins, tetanus vaccines, Antithrombin IIIs, Antivenom serums, Argatrobans, Arginines, Ascorbic acids, Atenolols, Atracuriums, Atropines, Aurothioglucoses, Azathioprines, Aztreonams, Bacitracins, Baclofens, Basiliximabs, Benzoic acids, Benztropines, Betamethasones, Biotins, Bivalirudins, Botulism antitoxins, Bretyliums, Bumetanides, Bupivacaines, Buprenorphines, Butorphanols, Calcitonins, Calcitriols, Calciums, Capreomycins, Carboprosts, Carnitines, Cefamandoles, Cefoperazones, Cefotaximes, Cefoxitins, Ceftizoximes, Cefuroximes, Chloramphenicols, Chloroprocaines, Chloroquines, Chlorothiazides, Chlorpromazines, Chondroitinsulfuric acids, Choriogonadotropin alfas, Chromiums, Cidofovirs, Cimetidines, Ciprofloxacins, Cisatracuriums, Clonidines, Codeines, Colchicines, Colistins, Collagens, Corticorelin ovine triflutates, Corticotrophins, Cosyntropins, Cyanocobalamins, Cyclosporines, Cysteines, Dacliximabs, Dalfopristins, Dalteparins, Danaparoids, Dantrolenes, Deferoxamines, Desmopressins, Dexamethasones, Dexmedetomidines, Dexpanthenols, Dextrans, Iron dextrans, Diatrizoic acids, Diazepams, Diazoxides, Dicyclomines, Digibinds, Digoxins, Dihydroergotamines, Diltiazems, Diphenhydramines, Dipyridamoles, Dobutamines, Dopamines, Doxacuriums, Doxaprams, Doxercalciferols, Doxycyclines, Droperidols, Dyphyllines, Edetic acids, Edrophoniums, Enalaprilats, Ephedrines, Epoprostenols, Ergocalciferols, Ergonovines, Ertapenems, Erythromycins, Esmolols, Estradiols, Estrogenics, Ethacrynic acids, Ethanolamines, Ethanols, Ethiodized oils, Etidronic acids, Etomidates, Famotidines, Fenoldopams, Fentanyls, Flumazenils, Fluoresceins, Fluphenazines, Folic acids, Fomepizoles, Fomivirsens, Fondaparinuxs, Foscarnets, Fosphenyloins, Furosemides, Gadoteridols, Gadoversetamides, Ganciclovirs, Gentamicins, Glucagons, Glucoses, Glycines, Glycopyrrolates, Gonadorelins, Gonadotropin chorionics, *Haemophilus* B polysaccharides, Hemins, Herbals, Histamines, Hydralazines, Hydrocortisones, Hydromorphones, Hydroxocobalamins, Hydroxyzines, Hyoscyamines, Ibutilides, Imiglucerases, Indigo carmines, Indomethacins, Iodides, Iopromides, Iothalamic acids, Ioxaglic acids, Ioxilans, Isoniazids, Isoproterenols, Japanese encephalitis vaccines, Kanamycins, Ketamines, Labetalols, Lepirudins, Levobupivacaines, Levothyroxines, Lincomycins, Liothyronines, Luteinizing hormones, Lyme disease vaccines, Mangafodipirs, Manthtols, Meningococcal polysaccharide vaccines, Meperidines, Mepivacaines, Mesoridazines, Metaraminols, Methadones, Methocarbamols, Methohexitals, Methyldopates, Methylergonovines, Metoclopramides, Metoprolols, Metronidazoles, Minocyclines, Mivacuriums, Morrhuic acids, Moxifloxacins, Muromonab-CD3s, Mycophenolate mofetils, Nafcillins, Nalbuphines, Nalmefenes, Naloxones, Neostigmines, Niacinamides, Nicardipines, Nitroglycerins, Nitroprussides, Norepinephrines, Orphenadrines, Oxacillins, Oxymorphones, Oxytetracyclines, Oxytocins, Pancuroniums, Panthenols, Pantothenic acids, Papaverines, Peginterferon alpha 2As, Penicillin Gs, Pentamidines, Pentazocines, Pentobarbitals, Perflutrens, Perphenazines, Phenobarbitals, Phentolamines, Phenylephrines, Phenyloins, Physostigmines, Phytonadiones, Polymyxin, Pralidoximes, Prilocalnes, Procainamides, Procaines, Prochlorperazines, Progesterones, Propranolols, Pyridostigmine hydroxides, Pyridoxines, Quinidines, Quinupristins, Rabies immunoglobulins, Rabies vaccines, Ranitidines, Remifentanils, Riboflavins, Rifampins, Ropivacaines, Samariums, Scopolamines, Seleniums, Sermorelins, Sincalides, Somatrems, Spectinomycins, Streptokinases, Streptomycins, Succinylcholines, Sufentanils, Sulfamethoxazoles, Tacrolimuses, Terbutalines, Teriparatides, Testosterones, Tetanus antitoxins, Tetracaines, Tetradecyl sulfates, Theophyllines, Thiamines, Thiethylperazines, Thiopentals, Thyroid stimulating hormones, Tinzaparins, Tirofibans, Tobramycins, Tolazolines, Tolbutamides, Torsemides, Tranexamic acids, Treprostinils, Trifluoperazines, Trimethobenzamides, Trimethoprims, Tromethamines, Tuberculins, Typhoid vaccines, Urofollitropins, Urokinases, Valproic acids, Vasopressins, Vecuroniums, Verapamils, Voriconazoles, Warfarins, Yellow fever vaccines, Zidovudines, Zincs, Ziprasidone hydrochlorides, Aclacinomycins, Actinomycins, Adriamycins, Azaserines, 6-Azauridines, Carzinophilins, Chromomycins, Denopterins, 6-Diazo 5 Oxo-L-Norleucines, Enocitabines, Floxuridines, Olivomycins, Pirarubicins, Piritrexims, Pteropterins, Tegafurs, Tubercidins, Alteplases, Arcitumomabs, bevacizumabs, Botulinum Toxin Type A's, Botulinum Toxin Type B's, Capromab Pendetides, Daclizumabs, Dornase alphas, Drotrecogin alphas, Imciromab Pentetates, Iodine-131's, an antibiotic agent; an angiogenesis inhibitor; anti-cataract and anti-diabetic retinopathy substances; carbonic anhydrase inhibitors; mydriatics; photodynamic therapy agents; prostaglandin analogs; growth factor; anti-neoplastics; anti-metabolites; anti-viral; amebicides and anti-protozoals; anti-tuberculosis and anti-leprotic; antitoxins and antivenins; antihemophilic factor, anti-inhibitor coagulant complex, antithrombin III, coagulations Factor V, coagulation Factor IX, plasma protein fraction, von Willebrand factor; anti-platelet agent a colony stimulating factor (CSF); an erythropoiesis stimulator; hemostatics and albumins; Immune Globulins; thrombin inhibitors; anticoagulants; a steroidal anti-inflammatory drug selected from among alclometasones, algestones, beclomethasones, betamethasones, budesonides, clobetasols, clobetasones, clocortolones, cloprednols, corticosterones, cortisones, cortivazols, deflazacorts, desonides, desoximetasones, dexamethasones, diflorasones, diflucortolones, difluprednates, enoxolones, fluazacorts, flucloronides, flumethasones, flunisolides, fluocinolones, fluocinonides, fluocortins, fluocortolones, fluorometholones, fluperolones, fluprednidenes, fluprednisolones, flurandrenolides, fluticasones, formocortals, halcinonides, halobetasols, halometasones, halopredones, hydrocortamates, hydrocortisones, loteprednol etabonate, mazipredones, medrysones, meprednisones, methylprednisolones, mometasone furoate, paramethasones, prednicarbates, prednisolones, prednisones, prednivals, prednylidenes, rimexolones, tixocortols and triamcinolones; Docosanols, prostaglandins, prostaglandin analogs, anti-prostaglandins and prostaglandin precursors; miotics, cholinergics and anti-cholinesterase; and anti-allergenics.

The compositions and modified PH20 polypeptides can be used to treat any condition normally treated by the PH20 polypeptide or the therapeutically active agent. These include, for example, conditions in which hyaluronan plays a role or is associated with the etiology of the disease due to, for example, accumulation or overproduction of hyaluronan. Hence provided are methods, uses of the compositions and modified PH20 polypeptides for treating a hyaluronan-associated disease or condition by administering any of the modified PH20 polypeptides or compositions provided herein. Hyaluronan-associated diseases and conditions include, for example, inflammatory disease and tumors or cancers, including a late-stage cancer, metastatic cancers and undifferentiated cancers, such as ovarian cancer, in situ carcinoma (ISC), squamous cell carcinoma (SCC), prostate cancer, pancreatic cancer, non-small cell lung cancer, breast cancer and colon cancer. The PH20 polypeptide can be modified to exhibit increased half-life for such treatments. For example, the PH20 polypeptide can be modified with a polymer such as a PEG moiety for such treatments.

Also provided are methods for increasing delivery of a therapeutic agent to a subject by: administering to a subject any of the modified PH20 polypeptides or compositions provided herein, and administering the therapeutic agent. The therapeutic agent can be administered in the same composition or separately, and can be administered before or after, simultaneously, or intermittently, with administration of the PH20 polypeptide(s). Administration includes any route, including intravenous and subcutaneous administration, such as simultaneously with, intermittently with, or subsequent to administration of the therapeutic agent. The therapeutic agents include any of those set forth above, elsewhere herein and/or known to those of skill in the art.

Also provided are methods for treating an excess of glycosaminoglycans; for treating a tumor; for treating glycosaminoglycan accumulation in the brain; for treating a cardiovascular disorder; for treating an ophthalmic disorder; for treating pulmonary disease; for increasing penetration of chemotherapeutic agents into solid tumors; for treating cellulite; for treating a proliferative disorder; or for increasing bioavailability of drugs and other therapeutic agents by administering the modified PH20 polypeptides or compositions provided herein.

Also provided are pharmaceutical compositions for use in treating a hyaluronan-associated disease or disorder; for use in delivering a therapeutic agent to a subject; for treating an excess of glycosaminoglycans; for treating a tumor; for treating glycosaminoglycan accumulation in the brain; for treating a cardiovascular disorder; for treating an ophthalmic disorder; for treating pulmonary disease; for increasing penetration of chemotherapeutic agents into solid tumors; for treating cellulite; for treating a proliferative disorder; or for increasing bioavailability of drugs and other therapeutic agents; and for any other use of compositions containing PH20 polypeptides.

Provided herein is a method for identifying or selecting a modified hyaluronan-degrading enzyme that exhibits stability under a denaturation condition that includes the steps of: a) testing the activity of a modified hyaluronan-degrading enzyme in a composition containing a denaturing agent and/or under a denaturing condition; b) testing the activity of the modified hyaluronan-degrading enzyme in the same composition and/or under the same conditions as a) except absent the denaturing agent or condition; and c) selecting or identifying a modified hyaluronan-degrading enzyme that exhibits activity in a) that is at least 5% of the activity in b). In such an example, the activity is hyaluronidase activity. In some examples of the methods, a modified hyaluronan-degrading enzyme is selected or identified if the activity in a) is at least 10%, 15%, 20%, 25%, 30%, 35%, 40%, 45%, 50%, 55%, 60%, 65%, 70%, 75%, 80%, 85%, 90%, 95% or more of the activity in b), for example, a modified hyaluronan-degrading enzyme is selected or identified if the activity in a) is at least 40% or more of the activity in b). The method also can include steps of: d) comparing the activity of the modified hyaluronan-degrading enzyme in a) to the activity of the unmodified hyaluronan-degrading enzyme tested under the same conditions; and e) identifying or selecting a modified hyaluronan-degrading enzyme that exhibits at least 120%, 130%, 135%, 140%, 145%, 150%, 160%, 170%, 180%, 200%, 250%, 300%, 350%, 400%, 500%, 1500%, 2000%, 3000%, 4000%, 5000% or more of the hyaluronidase activity compared to the unmodified hyaluronan-degrading enzyme.

Also provide herein is a method for identifying or selecting a modified hyaluronan-degrading enzyme that exhibits stability, such as increased stability, under a denaturation condition, that includes the steps of: a) testing the activity of a modified hyaluronan-degrading enzyme in a composition containing a denaturing agent and/or under a denaturing condition; b) testing the activity of the corresponding unmodified hyaluronan-degrading enzyme in a composition containing the same denaturing agent and/or under the same denaturing condition as a), whereby the activity is tested under the same conditions as a); and c) selecting or identifying a modified hyaluronan-degrading enzyme that exhibits greater activity than the unmodified hyaluronan-degrading enzyme, thereby identifying or selecting a modified hyaluronan-degrading enzyme that exhibits increased stability under a denaturation condition. In such an example, the activity can be a hyaluronidase activity. In examples of the method, a modified hyaluronan-degrading enzyme is selected or identified if the activity is at least 120%, 130%, 135%, 140%, 145%, 150%, 160%, 170%, 180%, 200%, 250%, 300%, 350%, 400%, 500%, 1500%, 2000%, 3000%, 4000%, 5000% or more of the activity compared to the unmodified hyaluronan-degrading enzyme. In such an example, the method also can include additional steps of: d) testing the activity of the selected or identified modified hyaluronan-degrading enzyme in a composition containing a denaturing agent and/or under a denaturing condition; e) testing the activity of the same selected or identified modified hyaluronan-degrading enzyme in the same composition and/or under the same conditions as d) except absent the denaturing agent or condition; and f) selecting or identifying a modified hyaluronan-degrading enzyme that exhibits activity in d) that is at least 5% of the activity in e). In such an example, the activity is hyaluronidase activity. In some examples of the methods, a modified hyaluronan-degrading enzyme is selected or identified if the activity in d) is at least 10%, 15%, 20%, 25%, 30%, 35%, 40%, 45%, 50%, 55%, 60%, 65%, 70%, 75%, 80%, 85%, 90%, 95% or more of the activity in e), for example, a modified hyaluronan-degrading enzyme is selected or identified if the activity in d) is at least 40% or more of the activity in e).

In any of the methods provided herein for identifying or selecting a modified hyaluronan-degrading enzyme, the denaturing agent or condition is caused by temperature, agitation, no or low salt or the presence of an excipient. For example, the denaturing agent or condition is caused by elevated temperature that is from or from about 30° C. to 42° C., such as greater than or greater than about 30° C., 31° C., 32° C., 33° C., 34° C., 35° C., 36° C., 37° C., 38° C., 39° C., 40° C., 41° C. or 42° C. In other examples, the denaturing agent or condition is the absence of salt or low salt less than 100 mM, such as low salt less than 90 mM, 80 mM, 70 mM, 60 mM, 50 mM, 40 mM, 30 mM, 25 mM, 20 mM, 15 mM, 10 mM, 5 mM. In further examples, the denaturing agent or condition is a denaturing excipient selected from among an antiadherents, binders, coatings, fillers and diluents, flavors, colors, lubricants, glidants, preservatives, sorbents and sweeteners.

In particular examples of any of the methods provided herein for identifying or selecting a modified hyaluronan-degrading enzyme, the denaturing agent or condition is a preservative(s), for example, a phenolic preservative(s). The phenolic preservative(s) can be a phenol, metacresol (m-cresol), benzyl alcohol, or a paraben. For example, the denaturing agent or condition is a preservative(s) that is phenol and/or m-cresol. In such examples, the total amount of phenolic preservative in the composition, as a percentage (%) of mass concentration (w/v), is from or from about 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4% inclusive.

In any of the methods provided herein for identifying or selecting a modified hyaluronan-degrading enzyme, prior to testing the activity of a hyaluronan-degrading enzyme composition in a) and/or b), the hyaluronan-degrading enzyme is exposed to the denaturation condition or denaturing agent for a predetermined time. The predetermined time is a time period that is user selected depending on the particular hyaluronan-degrading enzyme that is being evolved or selected, the particular denaturation condition or denaturing agent, the amount or extent of the denaturation condition or denaturing agent, the application or use of the hyaluronan-degrading enzyme and other similar factors. For example, the predetermined time can be from or from about 1 minute to 1 month, 1 minute to 3 weeks, 1 minute to 2 weeks, 1 minute to 1 week, 1 minute to 24 hours, 1 minute to 12 hours, 30 minutes to 6 hours or 1 hour to 4 hours, such as at least or about at least 30 minutes, 1 hour, 2 hours, 3 hours, 4 hours, 5 hours, 6 hours, 7 hours, 8 hours, 9 hours, 10 hours, 11 hours, 12 hours, 24 hours, two days, three days, four days, five days, six days, 7 days, two weeks or one month.

In any of the methods provided herein for identifying or selecting a modified hyaluronan-degrading enzyme, the modified hyaluronan-degrading enzyme is one that contains an amino acid replacement, insertion or deletion of amino acids compared to an unmodified hyaluronan-degrading enzyme. For example, the modified hyaluronan-degrading enzyme contains an amino acid replacement, such as a single amino acid replacement or two, three, four, five, six, seven, eight, nine or more amino acid replacements compared to an unmodified form of the hyaluronan-degrading enzyme. In particular aspects of the method, a library or collection of modified hyaluronan-degrading enzymes are screened in order to evolve or identify or select a modified hyaluronan-degrading enzyme that exhibits stability, such as increased stability, under a denaturation condition. Thus, in examples of the methods herein, a plurality of modified hyaluronan-degrading enzymes are tested in a) and/or b). In such examples, the plurality of modified hyaluronan-degrading enzymes are modified compared to the corresponding unmodified hyaluronan-degrading enzyme to generate a collection of modified hyaluronan-degrading enzymes, whereby each modified protein in the collection is tested in each of a) and/or b). In the collection or library, each modified hyaluronan-degrading enzyme contains a single amino acid replacement compared to the unmodified form of the hyaluronan-degrading enzyme, such that the plurality of modified enzymes are such that the amino acid at each modified position is replaced by up to 1-19 other amino acids other than the original amino acid at the position, whereby each modified hyaluronan-degrading enzyme contains a different amino acid replacement, and every amino acid along the length of the hyaluronan-degrading enzyme, or a selected portion thereof, is replaced.

In any of the methods provided herein, the modified hyaluronan-degrading enzyme is modified compared to an unmodified hyaluronan-degrading enzyme by insertion, deletion or replacement of an amino acid(s). The unmodified hyaluronan-degrading enzyme can be a chondroitinase or can be a hyaluronidase. In examples herein, the unmodified hyaluronidase is a PH20 hyaluronidase or truncated form thereof lacking a C-terminal glycosylphosphatidylinositol (GPI) anchor attachment site or a portion of the GPI anchor attachment site, whereby the truncated form exhibits hyaluronidase activity. PH20 hyaluronidase can be a human, monkey, bovine, ovine, rat, fox, mouse or guinea pig PH20. In particular examples, the PH20 hyaluronidase is a human PH20 or a C-terminal truncated form thereof. For example, the unmodified hyaluronan-degrading enzyme is one that has the sequence of amino acids set forth in any of SEQ ID NOS: 3, 7, 10, 12, 14, 24, 32-66, 69, 72, 857, 859, 861, 870 or a sequence of amino acids that is at least 80% sequence identity to any of SEQ ID NOS: 3, 7, 10, 12, 14, 24, 32-66, 69, 72, 857, 859, 861, 870, such as at least 85%, 86%, 87%, 88%, 89%, 90%, 91%, 92%, 93%, 94%, 95%, 96%, 97%, 98%, 99% sequence identity to any of SEQ ID NOS: 3, 7, 10, 12, 14, 24, 32-66, 69, 72, 857, 859, 861, or 870. In particular examples, the unmodified hyaluronan-degrading enzyme is a PH20 hyaluronidase having the sequence of amino acids set forth in any of SEQ ID NOS: 3, 7, 32-66, 69 or 72, or a sequence of amino acids that exhibits at least 85% sequence identity to any of SEQ ID NOS: 3, 7, 32-66, 69 or 72, such as a sequence of amino acids that exhibits at least 86%, 87%, 88%, 89%, 90%, 91%, 92%, 93%, 94%, 95%, 96%, 97%, 98%, 99% or more sequence identity to any of SEQ ID NOS: 3, 7, 32-66, 69 or 72.

In any of the methods provided herein for identifying or selecting a modified hyaluronan-degrading enzyme that exhibits stability, the method is performed in vitro. Also provided are any of the methods that are iterative, whereby the steps of the method are repeated a plurality of times, wherein in each repetition, further modified hyaluronan-degrading enzymes of a selected modified hyaluronan-degrading enzyme are generated and tested, whereby the modified hyaluronan-degrading enzyme is evolved to exhibit increased stability under a denaturation condition. Also provided herein is a modified hyaluronan-degrading enzyme identified by any of the methods provided herein.

BRIEF DESCRIPTION OF THE FIGURES

FIG. 1 depicts the amino acid sequence of full-length human PH20 (set forth in SEQ ID NO:7) and soluble C-terminal truncated variants thereof. The C-terminal amino acid residue of exemplary C-terminal truncated variants of full-length PH20 are indicated by bold font. The complete amino acid sequences of exemplary C-terminal truncated variants of full-length PH20 also are provided in SEQ ID NOS: 3 and 32-66. The C-terminal amino acid residue of an exemplary soluble PH20, whose complete sequence is set forth in SEQ ID NO:3, also is indicated by underline. Exemplary, non-limiting, positions for amino acid replacements are indicated by highlighting. Corresponding positions can be identified by alignment of a sequence of interest with any of SEQ ID NOS: 3, 7 or 32-66, and in particular with SEQ ID NO:3.

FIG. 2 (A-L) depicts exemplary alignments of human soluble PH20 set forth in SEQ ID NO:3 with other PH20 polypeptides. A "*" means that the aligned residues are identical, a ":" means that aligned residues are not identical, but are similar and contain conservative amino acids residues at the aligned position, and a "." means that the aligned residues are similar and contain semi-conservative amino acid residues at the aligned position. Exemplary, non-limiting, corresponding positions for amino acid replacements are indicated by highlighting. For example, FIG. 2A depicts the alignment of a human soluble PH20 set forth in SEQ ID NO:3 with chimpanzee PH20 set forth in SEQ ID NO:10. FIG. 2B depicts the alignment of a human soluble PH20 set forth in SEQ ID NO:3 with Rhesus monkey PH20 set forth in SEQ ID NO:12. FIG. 2C depicts the alignment of a human soluble PH20 set forth in SEQ ID NO:3 with Cynomolgus monkey PH20 set forth in SEQ ID NO: 14. FIG. 2D depicts the alignment of human soluble PH20 set forth in SEQ ID NO:3 with bovine PH20 set forth in SEQ ID NO:16. FIG. 2E depicts the alignment of a human soluble PH20 set forth in SEQ ID NO:3 with mouse PH20 set forth in SEQ ID NO:20. FIG. 2F depicts the alignment of a human soluble PH20 set forth in SEQ ID NO:3 with rat PH20 set forth in SEQ ID NO:22. FIG. 2G depicts the alignment of a human soluble PH20 set forth in SEQ ID NO:3 with rabbit PH20 set forth in SEQ ID NO:24. FIG. 2H depicts the alignment of a human soluble PH20 set forth in SEQ ID NO:3 with guinea pig PH20 set forth in SEQ ID NO:29. FIG. 2I depicts the alignment of a human soluble PH20 set forth in SEQ ID NO:3 with Fox PH20 set forth in SEQ ID NO:31. FIG. 2J depicts the alignment of a human soluble PH20 set forth in SEQ ID NO:3 with Gibbon PH20 set forth in SEQ ID NO:857. FIG. 2K depicts the alignment of a human soluble PH20 set forth in SEQ ID NO:3 with Marmoset PH20 set forth in SEQ ID NO: 859. FIG. 2L depicts the alignment of a human soluble PH20 set forth in SEQ ID NO:3 with Orangutan PH20 set forth in SEQ ID NO:861.

DETAILED DESCRIPTION

Outline
A. Definitions
B. PH20 Hyaluronidase
  1. Structure
  2. Function
  3. Soluble PH20 Polypeptides
C. Modified PH20 Polypeptides
  1. Active Mutants
    a. Increased Activity
    b. Increased Stability
      i. Phenophiles
      ii. Thermophiles
      iii. Absence of Salt
  2. Inactive Mutants
  3. Additional Modifications
    a. Decreased Immunogenicity
    b. Conjugation to Polymers
D. Methods for Identifying Modified Hyaluronan-Degrading Enzymes with Altered properties or Activities
  1. Hyaluronan-Degrading Enzymes and Libraries of Modified Hyaluronan-Degrading Enzymes
  2. Screening or Testing for a Desired Activity or Property
  3. Selection or Identification
  4. Iterative Methods
E. Production of Modified Polypeptides and Encoding Nucleic Acid Molecules
  1. Isolation or Preparation of Nucleic Acids Encoding PH20 Polypeptides
  2. Generation of Mutant or Modified Nucleic Acid and Encoding Polypeptides
  3. Vectors and Cells
  4. Expression
    a. Prokaryotic Cells
    b. Yeast Cells
    c. Insects and Insect Cells
    d. Mammalian expression
    e. Plants and plant cells
  5. Purification
  6. Modification of Polypeptides by PEGylation
F. Pharmaceutical Compositions and Formulations, Dosages and Administration
  1. Formulations (liquids, injectables, solutions and emulsions)
    a. Lyophilized
    b. Exemplary Formulations
      i. NaCl
      ii. pH and Buffer
      iii. Preservatives
      iv. Stabilizers
  2. Compositions for Other Routes of Administration
  3. Dosages and Administration
  4. Exemplary PH20-Insulin Co-Formulations
  5. Packaging, Articles of Manufacture and Kits
G. Methods of Assessing Hyaluronidase Activity
  1. Hyaluronidase Activity
  2. Solubility
  3. Purity, Crystallization or Aggregation
  4. Pharmacodynamics/Pharmacokinetics
H. Methods of Treatment and Combination Therapy
  1. Methods of Delivering Therapeutic Agents Delivery of Insulin
  2. Methods of Treating Hyaluronan-Associated Disease and Conditions
  3. Other Uses
  4. Contraception
I. Examples A. Definitions Unless defined otherwise, all technical and scientific terms used herein have the same meaning as is commonly understood by one of skill in the art to which the invention(s) belong. All patents, patent applications, published applications and publications, GenBank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, a hyaluronan-degrading enzyme refers to an enzyme that catalyzes the cleavage of a hyaluronan polymer (also referred to as hyaluronic acid or HA) into smaller molecular weight fragments. Exemplary hyaluronan-degrading enzymes are hyaluronidases, and particular chondroitinases and lyases that have the ability to depolymerize hyaluronan. Exemplary chondroitinases that are hyaluronan-degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase contains two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Pedobacter heparinus* (the *Proteus vulgaris* chondroitin-sulfate-ABC endolyase is set forth in SEQ ID NO:922; Sato et al. (1994) *Appl. Microbiol. Biotechnol.* 41(1):39-46). Exemplary chondroitinase AC enzymes from bacteria include, but are not limited to, those from *Pedobacter heparinus*, set forth in SEQ ID NO: 923, *Victivallis vadensis*, set forth in SEQ ID NO:924, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

As used herein, hyaluronidase refers to a class of enzymes that degrade hyaluronan. Hyaluronidases include, but are not limited to, bacterial hyaluronidases (EC 4.2.2.1 or EC 4.2.99.1), hyaluronidases from leeches, other parasites and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary human hyaluronidases include HYAL1, HYAL2, HYAL3, HYAL4, and PH20. Also included amongst hyaluronidases are soluble hyaluronidases, including, ovine and bovine PH20, and soluble PH20. Exemplary hyaluronidases include any set forth in SEQ ID NOS: 6, 7-31, 69, 70, 71, 72, 856-861, 869-921, mature forms thereof (lacking the signal sequence), or allelic or species variants thereof. Hyaluronidases also include truncated forms thereof that exhibit hyaluronidase activity, including C-terminal truncated variants that are soluble.

As used herein, PH20 refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides, including precursor and mature forms, include those from human (SEQ ID NO:6 and 7), chimpanzee (SEQ ID NO:8, 9, 10, 869 and 870), Rhesus monkey (SEQ ID NO:11 and 12), Cynomolgus monkey (SEQ ID NO:13 and 14), cow (e.g., SEQ ID NOS:15-18); mouse (SEQ ID NO:19 and 20); rat (SEQ ID NO:21 and 22); rabbit (SEQ ID NO:23 and 24); sheep (SEQ ID NOS:25-27), guinea pig (SEQ ID NO:28 and 29); fox (SEQ ID NO: 30 and 31); Gibbon (SEQ ID NO:856 and 857), Marmoset (SEQ ID NO:858 and 859) and orangutan (SEQ ID NO:860 and 861). Reference to PH20 includes precursor PH20 polypeptides and mature PH20 polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NO:7, or the mature forms thereof. PH20 polypeptides also include those that contain chemical or posttranslational modifications and those that do not contain chemical or posttranslational modifications. Such modifications include, but are not limited to, PEGylation, albumination, glycosylation, farnysylation, carboxylation, hydroxylation, phosphorylation, and other polypeptide modifications known in the art. Examples of commercially available bovine or ovine soluble hyaluronidases are Vitrase® hyaluronidase (ovine hyaluronidase) and Amphadase® hyaluronidase (bovine hyaluronidase).

As used herein, a soluble PH20 refers to a polypeptide characterized by its solubility under physiological conditions. Generally, a soluble PH20 lacks all or a portion of a glycophosphatidyl anchor (GPI) attachment sequence, or does not otherwise sufficiently anchor to the cell membrane. For example, a soluble PH20 can be a C-terminally truncated variant of a PH20 lacking a contiguous sequence of amino acids that corresponds to all or a portion of a glycophosphatidyl anchor (GPI) attachment sequence. Hence, upon expression from a cell, a soluble PH20 is secreted into the medium. Soluble PH20 proteins can be distinguished, for example, by its partitioning into the aqueous phase of a Triton X-114 solution warmed to 37° C. (Bordier et al., (1981) J. Biol. Chem., 256:1604-7). Membrane-anchored, such as lipid anchored hyaluronidases, will partition into the detergent rich phase, but will partition into the detergent-poor or aqueous phase following treatment with Phospholipase-C. Included among soluble PH20 hyaluronidases are membrane anchored hyaluronidases in which one or more regions associated with anchoring of the hyaluronidase to the membrane has been removed or modified, where the soluble form retains hyaluronidase activity. Soluble hyaluronidases include recombinant soluble hyaluronidases and those contained in or purified from natural sources, such as, for example, testes extracts from sheep or cows. Exemplary of such soluble hyaluronidases are soluble human PH20 (SEQ ID NO: 3 or 32-66). Other soluble hyaluronidases include ovine (SEQ ID NO:25-27) and bovine (SEQ ID NO:16 or 18) PH20.

As used herein, soluble human PH20 (sHuPH20) includes human PH20 polypeptides that lack a contiguous sequence of amino acids from the C-terminus of human PH20 that includes all or a portion of the glycosylphosphatidylinositol (GPI) anchor sequence (C-terminally truncated PH20 polypeptides) such that upon expression, the polypeptides are soluble under physiological conditions. For example, soluble human PH20 polypeptides are C-terminally truncated polypeptides of human PH20 set forth as SEQ ID NO:6 in its precursor form or in SEQ ID NO:7 in its mature form lacking the signal sequence, or allelic variants thereof (e.g. set forth in any of SEQ ID NOS: 68-72). Solubility can be assessed by any suitable method that demonstrates solubility under physiologic conditions. Exemplary of such methods is the Triton® X-114 assay, that assesses partitioning into the aqueous phase and that is described above. In addition, a soluble human PH20 polypeptide is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble in the media, i.e., partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e., native) signal sequence. Exemplary of the precursors are those that include a signal sequence, such as the native 35 amino acid signal sequence at amino acid positions 1-35 (see, e.g., amino acids 1-35 of SEQ ID NO:6).

As used herein, "native" or "wildtype" with reference to a PH20 polypeptide refers to a PH20 polypeptide encoded by a native or naturally occurring PH20 gene, including allelic variants, that is present in an organism, including a human and other animals, in nature. Reference to wild-type PH20 without reference to a species is intended to encompass any species of a wild-type PH20. Included among wild-type PH20 polypeptides are the encoded precursor polypeptide, fragments thereof, and processed forms thereof, such as a mature form lacking the signal peptide as well as any pre- or post-translationally processed or modified forms thereof. Also included among native PH20 polypeptides are those that are post-translationally modified, including, but not limited to, those that are modified by glycosylation, carboxylation and/or hydroxylation. The amino acid sequences of exemplary wild-type human PH20 are set forth in SEQ ID NOS: 6 and 7 and those of allelic variants, including mature forms thereof, are set forth in SEQ ID NOS:68-72. Other animals produce native PH20, including, but not limited to, native or wildtype sequences set forth in any of SEQ ID NOS: 8-31, 856-861, 869 or 870.

As used herein, modification is in reference to modification of a sequence of amino acids of a polypeptide or a sequence of nucleotides in a nucleic acid molecule and includes deletions, insertions, and replacements of amino acids and nucleotides, respectively. Modifications also can include post-translational modifications or other changes to the molecule that can occur due to conjugation or linkage, directly or indirectly, to another moiety. Methods of modifying a polypeptide are routine to those of skill in the art, such as by using recombinant DNA methodologies.

As used herein, a "modified hyaluronan-degrading enzyme" refers to a hyaluronan-degrading enzyme that contains a modification compared to a reference or unmodified hyaluronan-degrading enzyme. The modification can be an amino acid replacement (substitution), insertion (addition) or deletion of one or more amino acid residues. The amino acid residue can be a natural or non-natural amino acid. In some cases, the modification can be a post-translational modification. A modified hyaluronan-degrading enzyme can have up to 150 amino acid differences compared to a reference or unmodified hyaluronan-degrading enzyme, so long as the resulting modified hyaluronan-degrading enzyme exhibits hyaluronidase activity. Typically, a modified hyaluronan-degrading enzyme contains 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acid modifications.

As used herein, an unmodified hyaluronan-degrading enzyme refers to a starting polypeptide that is selected for modification as provided herein. The starting polypeptide can be a naturally-occurring, wild-type form of a polypeptide. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in an amino acid residue or residues to alter glycosylation, can be selected for modification, and hence referred to herein as unmodified, for further modification. An unmodified hyaluronan-degrading enzyme includes human and non-human hyaluronan-degrading enzymes, including hyaluronan-degrading enzymes from non-human mammals and bacteria. Exemplary unmodified hyaluronan-degrading enzyme are any set forth in SEQ ID NOS: 2, 3, 6, 7-66, 68-72, 856-861, 869-924 or mature, C-terminally truncated forms thereof that exhibit hyaluronidase activity, or a hyaluronan-degrading enzyme that exhibits at least 75%, 80%, 85%, 86%, 87%, 88%, 89%, 90%, 91%, 92%, 93%, 94%, 95%, 96%, 97%, 98%, or 99% sequence identity to any of SEQ ID NOS: 2, 3, 6, 7-66, 68-72, 856-861, 869-924. It is understood that an unmodified hyaluronan-degrading enzyme generally is one that does not contain the modification(s), such as amino acid replacement(s) of a modified hyaluronan-degrading enzyme.

As used herein, "modified PH20 polypeptide" or "variant PH20 polypeptide" refers to a PH20 polypeptide that contains at least one amino acid modification, such as at least one amino acid replacement as described herein, in its sequence of amino acids compared to a reference unmodified PH20 polypeptide. A modified PH20 polypeptide can have up to 150 amino acid replacements, so long as the resulting modified PH20 polypeptide exhibits hyaluronidase activity. Typically, a modified PH20 polypeptide contains 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acid replacements. It is understood that a modified PH20 polypeptide also can include any one or more other modifications, in addition to at least one amino acid replacement as described herein.

As used herein, an unmodified PH20 polypeptide refers to a starting PH20 polypeptide that is selected for modification as provided herein. The starting polypeptide can be a naturally-occurring, wild-type form of a polypeptide. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in an amino acid residue or residues to alter glycosylation, can be selected for modification, and hence referred to herein as unmodified, for further modification. Exemplary unmodified PH20 polypeptides is a human PH20 polypeptide or allelic or species variants thereof or other variants, including mature and precursor polypeptides. For example, exemplary reference PH20 polypeptides is a mature full length PH20 polypeptide set forth in SEQ ID NOS: 7, 69 or 72, or in C-terminally truncated forms thereof such as set forth in any of SEQ ID NOS: 3 and 32-66, or in a PH20 polypeptide that exhibits at least 68%, 69%, 70%, 75%, 80%, 85%, 86%, 87%, 88%, 89%, 90%, 91%, 92%, 93%, 94%, 95%, 96%, 97%, 98%, or 99% sequence identity to any of SEQ ID NOS: 3, 7, 32-66, 69 or 72. A reference PH20 polypeptide also can include the corresponding precursor form such as set forth in any of SEQ ID NOS: 2, 6, 68, 70, 71 or other precursor forms, or in a PH20 polypeptide that exhibits at least 68%, 69%, 70%, 75%, 80%, 85%, 86%, 87%, 88%, 89%, 90%, 91%, 92%, 93%, 94%, 95%, 96%, 97%, 98%, or 99% sequence identity to any of SEQ ID NOS: 2, 6, 68, 70, 71. It is understood that an unmodified hyaluronan-degrading enzyme generally is one that does not contain the modification(s), such as amino acid replacement(s) of a modified hyaluronan-degrading enzyme.

As used herein, an N-linked moiety refers to an asparagine (N) amino acid residue of a polypeptide that is capable of being glycosylated by post-translational modification of a polypeptide. Exemplary N-linked moieties of human PH20 include amino acids N47, N131, N200, N219, N333, N358 and N365 of the sequence of amino acids set forth in SEQ ID NO: 3 or 7 (corresponding to amino acid residues N82, N166, N235, N254, N368, N393 and N490 of human PH20 set forth in SEQ ID NO: 6).

As used herein, an N-glycosylated polypeptide refers to a PH20 polypeptide containing oligosaccharide linkage of at least three N-linked amino acid residues, for example, N-linked moieties corresponding to amino acid residues N200, N333 and N358 of SEQ ID NO:3 or 7. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an N-partially glycosylated polypeptide refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, "conditions" refers to any parameter that can influence the activity or properties of a protein or agent. For purposes herein, conditions generally refer to the presence, including amount, of excipients, carriers or other components in a formulation other than the active agent (e.g., modified PH20 hyaluronidase); temperature; time (e.g., time of storage or exposure); storage vessel; properties of storage (e.g., agitation) and/or other conditions associated with exposure or use.

As used herein, "denaturation" or "denaturing" or grammatical variations thereof with reference to a protein refers to a biochemical change in a protein so that a property or activity of the protein is diminished or eliminated. The biochemical change can be a change in the tertiary structure of the protein to unfold. The property or activity can be completely abolished or can be reduced by 10%, 20%, 30%, 40%, 50%, 60%, 70%, 80%, 90%, 95% or more.

As used herein, property refers to a physical or structural property, such as the three-dimensional structure, pi, half-life, conformation and other such physical characteristics. For example, a change in a property can be manifested as the solubility, aggregation or crystallization of a protein.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, hyaluronidase activity refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including modified PH20 polypeptides, are known in the art and described herein. Exemplary assays include the microturbidity assay described herein that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, neutral active refers to the ability of a PH20 polypeptide to enzymatically catalyze the cleavage of hyaluronic acid at neutral pH, such as at a pH between or about between pH 6.0 to pH 7.8.

As used herein, "increased activity" with reference to a modified PH20 hyaluronidase means that, when tested under the same conditions, the modified PH20 hyaluronidase exhibits greater hyaluronidase activity compared to an unmodified PH20 hyaluronidase not containing the amino acid replacement(s). For example, a modified PH20 hyaluronidase exhibits at least or about at least 110%, 120%, 130%, 140%, 150%, 160%, 170%, 180%, 190%, 200%, 250%, 300%, 400%, 500%, 600%, 700%, 800%, 900%, 1000% or more of the activity of the unmodified or reference PH20 hyaluronidase.

As used herein, "solubility" with reference to a protein refers to a protein that is homogenous in an aqueous solution, whereby protein molecules diffuse and do not sediment spontaneously. Hence a soluble protein solution is one in which there is an absence of a visible or discrete particle in a solution containing the protein, such that the particles cannot be easily filtered. Generally, a protein is soluble if there are no visible or discrete particles in the solution. For example, a protein is soluble if it contains no or few particles that can be removed by a filter with a pore size of 0.22 μm.

As used herein, aggregation or crystallization with reference to a protein refers to the presence of visible or discrete particles in a solution containing the protein. Typically, the particles are greater than 10 μm in size, such as greater than 15 μm, 20 μm, 25 μm, 30 μm, 40 μm, 50 μm or greater. Aggregation or crystallization can arise due to reduced solubility, increased denaturation of a protein or the formation of covalent bonds.

As used herein, "denaturing condition" or "denaturation condition" refers to any condition or agent that, when exposed to a protein, affects or influences the degradation or denaturation of the protein, generally as a result of a loss or partial loss of the tertiary or secondary structure of the protein. Denaturing conditions can result in effects such as loss or reduction in activity, loss or reduction of solubility, aggregation and/or crystallization. The denaturing condition need not be one that is completely deadly to the protein, but nevertheless is one that leads to a reduction in the activity of the protein over time. Thus, a condition is denaturing if the activity of the protein is reduced by at least 10%, 20%, 30%, 40%, 50%, 60%, 70%, 80%), 90%, 95% or more in the presence of the condition than in its absence. A denaturing condition can be due to an external stress or physical condition (e.g., agitation, temperature, time of storage, absence of a stabilizer) or can be due to the presence of a denaturing agent. For example, the denaturing condition can be caused by heat, acid or a chemical denaturant. Exemplary denaturing conditions include, but are not limited to, the presence of a strong acid or base, a concentrated inorganic salt, an organic solvent (e.g., alcohol or chloroform), urea, high or low pH (extremes of pH), elevated temperature (e.g., heat), the presence of excipients that can be denaturing (e.g., phenolic preservatives or detergent), and low or substantially no stabilizing agent that otherwise is required for stability of the protein (e.g., NaCl).

As used herein, "denaturing agent" or "denaturant" refers to any substance, molecule or compound that causes denaturation. For example, a denaturing agent can include a strong acid or base, a concentrated inorganic salt, an organic solvent (e.g., alcohol or chloroform), a preservative, detergent or other excipient.

As used herein, "resistance to a denaturation condition" refers to any amount of decreased reduction or elimination of a property or activity of the protein associated with or caused by denaturation. For example, denaturation is associated with or causes increased crystallization or aggregation, reduced solubility or decreased activity. Hence, resistance to denaturation means that the protein exhibits decreased aggregation or crystallization, increased solubility or increased or greater activity (e.g., hyaluronidase activity) when exposed to a denaturing condition compared to a reference protein (e.g. unmodified enzyme). The resistance to a denaturation condition need not be absolute or permanent, but can be achieved because the denaturation of the modified hyaluronan-degrading enzyme occurs more slowly than the unmodified enzyme in the denaturation condition such that an activity or property of the modified hyaluronan-degrading enzyme is achieved for longer. For example, a modified hyaluronan-degrading enzyme, such as a modified PH20 hyaluronidase, exhibits resistance to a denaturation condition if it exhibits, for example, 1%, 2%, 3%, 4%, 5%, 6%, 7%, 8%, 9%, 10%, ... 20%, ... 30%, ... 40%, ... 50%, ... 60%, 70%, ... 80%, ... 90%, 91%, 92%, 93%, 94%, 95%, 96%, 97%, 98%, 99%, or 100%) more resistance to denaturation in the presence of a denaturation condition or denaturing agent than an unmodified polypeptide. In some instances, a modified polypeptide exhibits 105%, 110%, 120%, 130%, 140%), 150%, 200%, 300%), 400%, 500%, or more increased resistance to denaturation compared to an unmodified polypeptide.

As used herein, stability of a modified PH20 hyaluronidase means that it exhibits resistance to denaturation caused by a denaturation condition or denaturing agent. A modified PH20 polypeptide exhibits stability if it retains some activity in the presence of a denaturation condition or denaturing agent, such as at least 20%, 30%), 40%), 50%, 60%, 70%, 80%, 90% or more of the original or initial hyaluronidase activity prior to exposure to the denaturing condition(s). Generally, a modified PH20 hyaluronidase is stable if it retains at least 50% or more of the hyaluronidase activity under a denaturation condition compared to the absence of the denaturation condition. Assays to assess hyaluronidase activity are known to one of skill in the art and described herein. It is understood that the stability of the enzyme need not be permanent or long term, but is manifested for a duration of time in which activity is desired. For example, a modified PH20 hyaluronidase is stable if it exhibits an activity for at least 2 hours, 3 hours, 4 hours, 6 hours, 12 hours, 24 hours, one day, two days, three days, four days, five days, six days, one week, one month, six months or one year upon exposure, or during exposure, to one or more denaturing condition(s) or agent(s) (e.g., presence of a denaturing excipient such as a preservative). For example, a modified PH20 hyaluronidase is stable if it exhibits an activity upon or during exposure to one or more denaturing condition(s) or agent(s) (e.g., presence of a denaturing excipient such as a preservative) for at least 1 month at temperatures from or from about 2° C. to 8° C., inclusive or for at least 3 days at a temperature from or from about 30° C. to 42° C., inclusive.

Hence, "stable" or "stability," with reference to a formulation or a co-formulation provided herein, refers to one in which a modified hyaluronan-degrading enzyme, such as a modified PH20 hyaluronidase, therein is stable upon exposure to one or more denaturing condition(s) or agent(s) therein (e.g., presence of a denaturing excipient such as a preservative) for at least 1 month at temperatures from or from about 2° C. to 8° C., inclusive or for at least 3 days at a temperature from or from about 30° C. to 42° C., inclusive.

As used herein, "increased stability" with reference to a modified PH20 hyaluronidase means that, in the presence of the same denaturing or denaturation condition(s) (e.g., presence of a denaturing excipient such as a preservative), the modified PH20 hyaluronidase exhibits greater hyaluronidase activity compared to an unmodified PH20 hyaluronidase not containing the amino acid replacements). For example, a modified PH20 hyaluronidase exhibits increased stability if it exhibits at least or about at least 110%, 120%, 130%, 140%, 150%, 160%, 170%, 180%, 190%, 200%, 250%, 300%, 400%, 500%, 600%, 700%, 800%, 900%, 1000% or more of the activity of the unmodified or reference PH20 hyaluronidase in the presence of a denaturing or denaturation condition(s) (e.g., in the presence of a denaturing excipient such as a preservative).

As used herein, "elevated temperatures" refers to temperatures that are greater than room temperature or ambient temperature. Generally, an elevated temperature is a temperature that is at least, greater than, or about 30° C., such as 30° C. to 42° C., and generally 32° C. to 37° C. or 35° C. to 37° C., inclusive.

As used herein, room temperature refers to a range generally from about or at to 18° C. to about or at 32° C. Those of skill in the art appreciate that room temperature varies by location and prevailing conditions. For example, room temperatures can be higher in warmer climates such as Italy or Texas.

As used herein, recitation that proteins are "compared under the same conditions" means that different proteins are treated identically or substantially identically such that any one or more conditions that can influence the activity or properties of a protein or agent are not varied or not substantially varied between the test agents. For example, when the hyaluronidase activity of a modified PH20 polypeptide is compared to an unmodified PH20 polypeptide any one or more conditions such as the amount or concentration of the polypeptide; presence, including amount, of excipients, carriers or other components in a formulation other than the active agent (e.g., modified PH20 hyaluronidase); temperature; time of storage; storage vessel; properties of storage (e.g., agitation) and/or other conditions associated with exposure or use are identical or substantially identical between and among the compared polypeptides.

As used herein, "predetermined time" refers to a time that is established or decided in advance. For example, the predetermined time can be a time chosen in advance that is associated with the desired duration of activity of a hyaluronan-degrading enzyme depending on the desired application or use of the protein. A predetermined time can be hours, days, months or years. For example, a predetermined time can be at least about or about 2 hours, 3 hours, 4 hours, five hours, six hours, 12 hours, 24 hours, 2 days, three days, four days, five days, six days, one week, two weeks, three weeks, one month, six months, one year or more.

As used herein, "storage" means that a formulation is not immediately administered to a subject once prepared, but is kept for a period of time under particular conditions (e.g., particular temperature; time, and/or form (e.g., liquid or lyophilized form)) prior to use. For example, a liquid formulation can be kept for days, weeks, months or years, prior to administration to a subject under varied temperatures such as refrigerated (0° C. to 10° C., such as 2° to 8° C.), room temperature (e.g., temperature up to 32° C., such as 18° C. to about or at 32° C.), or elevated temperature (e.g., 30° C. to 42° C., such as 32° C. to 37° C. or 35° C. to 37° C.).

As used herein, an "excipient" refers to a compound in a formulation of an active agent that does not provide the biological effect of the active agent when administered in the absence of the active agent. Exemplary excipients include, but are not limited to, salts, buffers, stabilizers, tonicity modifiers, metals, polymers, surfactants, preservatives, amino acids and sugars.

As used herein, a stabilizing agent refers to compound added to the formulation to protect the modified PH20 polypeptide or other active agent from degradation, if necessary, such as due to denaturation conditions to which a formulation herein is exposed when handled, stored or used. Thus, included are agents that prevent proteins from degradation from other components in the compositions. Exemplary of such agents are amino acids, amino acid derivatives, amines, sugars, polyols, salts and buffers, surfactants, inhibitors or substrates and other agents as described herein.

As used herein, an antimicrobial effectiveness test or preservative effectiveness test (PET) demonstrates the effectiveness of the preservative system in a product. A product is inoculated with a controlled quantity of specific organisms. The test then compares the level of microorganisms found on a control sample versus the test sample over a period of 28 days. Generally, target markets have differing PET requirements. For example, the PET requirements of the United States Pharmacopoeia (USP) and the European Pharmacopoeia (EP) differ. Parameters for performing an antimicrobial effectiveness test, including in different markets, are known to one of skill in the art as described herein.

As used herein, an anti-microbially or anti-microbial effective amount of a preservative refers to an amount of the preservative that kills or inhibits the propagation of microbial organisms in a sample that may be introduced from storage or use. For example, for multiple-dose containers, an anti-microbially effective amount of a preservative inhibits the growth of microorganisms that may be introduced from repeatedly withdrawing individual doses. USP and EP (EPA and EPB) have anti-microbial requirements that determine preservative effectiveness, and that vary in stringency. For example, an anti-microbial effective amount of a preservative is an amount such that at least a 1.0 $\log_{10}$ unit reduction in bacterial organisms occurs at 7 days following inoculation in an antimicrobial preservative effectiveness test (APET). In a particular example, an anti-microbial effective amount of a preservative is an amount such that at least a 1.0 $\log_{10}$ unit reduction in bacterial organisms occurs at 7 days following inoculation, at least a 3.0 $\log_{10}$ unit reduction of bacterial organisms occurs at 14 days following inoculation, at least no further increase in bacterial organisms occurs after 28 days following inoculation, and at least no increase in fungal organisms occurs after 7 days following inoculation. In a further example, an anti-microbial effective amount of a preservative is an amount such that at least a 1.0 $\log_{10}$ unit reduction of bacterial organisms occurs at 24 hours following inoculation, at least a 3.0 $\log_{10}$ unit reduction of bacterial organisms occurs at 7 days following inoculation, no further increase in bacterial organisms occurs after 28 days following inoculation, at least a 1.0 $\log_{10}$ unit reduction of fungal organisms occurs at 14 days following inoculation, and at least no further increase in fungal organisms occurs after 28 days following inoculation. In an additional example, an anti-microbial effective amount of a preservative is an amount such that at least a 2.0 $\log_{10}$ unit reduction of bacterial organisms occurs at 6 hours following inoculation, at least a 3.0 $\log_{10}$ unit reduction of bacterial organisms occurs at 24 hours following inoculation, no recovery of bacterial organisms occurs after 28 days following inoculation of the composition with the microbial inoculum, at least a 2.0 $\log_{10}$ unit reduction of fungal organisms occurs at 7 days following inoculation, and at least no further increase in fungal organisms occurs after 28 days following inoculation.

As used herein, "preservative" refers to a naturally occurring or synthetically or recombinantly produced substance that, when added to a molecule or protein composition, prevents microbial growth, including bacterial or fungal growth, in the composition.

As used herein, a "phenolic preservative" refers to a preservative that contains one hydroxyl group attached to an aromatic carbon ring, such as a benzene ring. Exemplary phenolic preservatives, include but are not limited to, phenol, m-cresol, p-hydroxybenzoic acid, methylparaben, ethylparaben, and propylparaben. For example, cresols, including meta-cresol (m-cresol), has a methyl group substituted onto the benzene ring of a phenol molecule.

As used herein, a "phenophile" refers to a protein, such a modified PH20 polypeptide, that exhibits stability in the presence of an anti-microbially effective amount of a preservative(s). The term "phenophile" can be used interchangeably herein with "phenolphile" and has the same meaning. For example, a modified PH20 polypeptide that is a phenophile or phenolphile typically exhibits increased stability compared to an unmodified PH20 hyaluronidase not containing the amino acid replacements) when tested under the same denaturing condition(s) containing a phenolic preservative(s). For example, a modified PH20 hyaluronidase exhibits at least or about at least 110%, 120%, 130%, 140%, 150%, 160%, 170%), 180%, 190%), 200%, 250%, 300%, 400%, 500%, 600%), 700%, 800%, 900%, 1000% or more of the activity of the unmodified or reference PH20 hyaluronidase in the presence of a phenolic preservative(s).

As used herein, a "thermophile" refers to a protein, such as a modified PH20 polypeptide, that exhibits stability under elevated temperatures greater than or about 30° C., such as 30° C. to 42° C., and generally 32° C. to 37° C. or 35° C. to 37° C. For example, a modified PH20 polypeptide that is a thermophile typically exhibits increased stability compared to an unmodified PH20 hyaluronidase not containing the amino acid replacement(s) when tested under the same elevated temperature denaturing condition(s). For example, a modified PH20 hyaluronidase exhibits at least or about at least 110%, 120%, 130%, 140%, 150%, 160%, 170%, 180%, 190%, 200%, 250%, 300%, 400%, 500%, 600%, 700%, 800%, 900%), 1000% or more of the activity of the unmodified or reference PH20 hyaluronidase under elevated temperatures.

As used herein, the term "detergent" is used interchangeably with the term "surfactant" or "surface acting agent." Surfactants are typically organic compounds that are amphiphilic, i.e., containing both hydrophobic groups ("tails") and hydrophilic groups ("heads"), which render surfactants soluble in both organic solvents and water. A surfactant can be classified by the presence of formally charged groups in its head. A non-ionic surfactant has no charge groups in its head, whereas an ionic surfactant carries a net charge in its head. A zwitterionic surfactant contains a head with two oppositely charged groups. Some examples of common surfactants include: Anionic (based on sulfate, sulfonate or carboxylate anions): perfluorooctanoate (PFOA or PFO), perfluorooctane sulfonate (PFOS), sodium dodecyl sulfate (SDS), ammonium lauryl sulfate, and other alkyl sulfate salts, sodium laureth sulfate (also known as sodium lauryl ether sulfate, or SLES), alkyl benzene sulfonate; cationic (based on quaternary ammonium cations): cetyl trimethylammonium bromide (CTAB) a.k.a. hexadecyl trimethyl ammonium bromide, and other alkyltrimethylammonium salts, cetylpyridinium chloride (CPC), polyethoxylated tallow amine (POEA), benzalkonium chloride (BAC), benzethonium chloride (BZT); Zwitterionic (amphoteric): dodecyl betaine; cocamidopropyl betaine; coco ampho glycinate;

nonionic: alkyl poly(ethylene oxide), alkylphenol poly(ethylene oxide), copolymers of poly(ethylene oxide) and poly(propylene oxide) (commercially known as Poloxamers or Poloxamines), alkyl polyglucosides, including octyl glucoside, decyl maltoside, fatty alcohols (e.g., cetyl alcohol and oleyl alcohol), cocamide MEA, cocamide DEA, polysorbates (Tween 20, Tween 80, etc.), Triton detergents, and dodecyl dimethylamine oxide.

As used herein, a "buffer" refers to a substance, generally a solution, that can keep its pH constant, despite the addition of strong acids or strong bases and external influences of temperature, pressure, volume or redox potential. A buffer prevents change in the concentration of another chemical substance, e.g., proton donor and acceptor systems that prevent marked changes in hydrogen ion concentration (pH). The pH values of all buffers are temperature and concentration dependent. The choice of buffer to maintain a pH value or range can be empirically determined by one of skill in the art based on the known buffering capacity of known buffers. Exemplary buffers include but are not limited to, bicarbonate buffer, cacodylate buffer, phosphate buffer or Tris buffer. For example, Tris buffer (tromethamine) is an amine based buffer that has a pKa of 8.06 and has an effective pH range between 7.9 and 9.2. For Tris buffers, pH increases about 0.03 unit per ° C. temperature decrease, and decreases 0.03 to 0.05 unit per ten-fold dilution.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in J. Biol. Chem., 243:3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic Acid |
| Z | Glx | Glu and/or Gln |
| W | Trp | Tryptophan |
| R | Arg | Arginine |
| D | Asp | Aspartic Acid |
| N | Asn | Asparagine |
| B | Asx | Asn and/or Asp |
| C | Cys | Cysteine |
| X | Xaa | Unknown or Other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, an isokinetic mixture is one in which the molar ratios of amino acids has been adjusted based on their reported reaction rates (see, e.g., Ostresh et al., (1994) Biopolymers 34:1681).

As used herein, suitable conservative substitutions of amino acids are known to those of skill in this art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 20 nucleotides in length.

As used herein, "at a position corresponding to" or recitation that nucleotides or amino acid positions "correspond to" nucleotides or amino acid positions in a disclosed sequence, such as set forth in the Sequence listing, refers to nucleotides or amino acid positions identified upon alignment with the disclosed sequence to maximize identity using a standard alignment algorithm, such as the GAP algorithm. For purposes herein, alignment of a PH20 sequence is to the amino acid sequence set forth in any of SEQ ID NOS: 3, 7 or 32-66, and in particular SEQ ID NO:3. Hence, reference herein that a position or amino acid replacement corresponds to positions with reference to SEQ ID NO:3 also means that the position or amino acid replacement corresponds to positions with reference to any of SEQ ID NOS: 7 or 32-66, since the sequences therein are identical to the corresponding residues as set forth in SEQ ID NO:3. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073). FIG. 2 (A-L) exemplifies exemplary alignments and identification of exemplary corresponding residues for replacement.

As used herein, "sequence identity" refers to the number of identical or similar amino acids or nucleotide bases in a comparison between a test and a reference polypeptide or polynucleotide. Sequence identity can be determined by sequence alignment of nucleic acid or protein sequences to identify regions of similarity or identity. For purposes herein, sequence identity is generally determined by alignment to identify identical residues. Alignment can be local or global, but for purposes herein alignment is generally a global alignment where the full-length of each sequence is compared. Matches, mismatches and gaps can be identified between compared sequences. Gaps are null amino acids or nucleotides inserted between the residues of aligned sequences so that identical or similar characters are aligned. Generally, there can be internal and terminal gaps. Sequence identity can be determined by taking into account gaps as the number of identical residues/length of the shortest sequence×100. When using gap penalties, sequence identity can be determined with no penalty for end gaps (e.g., terminal gaps are not penalized). Alternatively, sequence identity can be determined without taking into account gaps as the number of identical positions/length of the total aligned sequence×100.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences will be taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. *J. Mol. Biol.* 48:443 (1970). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequence, but only aligns those portions of the sequences that share similarity or identity. Hence, a local alignment determines if sub-segments of one sequence are present in another sequence. If there is no similarity, no alignment will be returned. Local alignment algorithms include BLAST or Smith-Waterman algorithm (*Adv. Appl. Math.* 2:482 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

For purposes herein, sequence identity can be determined by standard alignment algorithm programs used with default gap penalties established by each supplier. Default parameters for the GAP program can include: (1) a unary comparison matrix (containing a value of 1 for identities and 0 for non identities) and the weighted comparison matrix of Gribskov et al. *Nucl. Acids Res.* 14:6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Whether any two nucleic acid molecules have nucleotide sequences or any two polypeptides have amino acid sequences that are at least 80%, 85%, 90%, 95%, 96%, 97%, 98% or 99% "identical," or other similar variations reciting a percent identity, can be determined using known computer algorithms based on local or global alignment (see e.g., wikipedia.org/wiki/Sequence_alignment_software, providing links to dozens of known and publicly available alignment databases and programs). Generally, for purposes herein sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and program from Xiaoqui Huang available at deepc2.psi.iastate.edu/aat/align/align.html. Generally, when comparing nucleotide sequences herein, an alignment with penalty for end gaps is used. Local alignment also can be used when the sequences being compared are substantially the same length.

Therefore, as used herein, the term "identity" represents a comparison or alignment between a test and a reference polypeptide or polynucleotide. In one non-limiting example, "at least 90% identical to" refers to percent identities from 90 to 100% relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., $10/100$ amino acid difference (approximately 90% identity). Differences also can be due to deletions or truncations of amino acid residues. Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. Exemplary of species variants provided herein are primate PH20, such as, but not limited to, human, chimpanzee, macaque, cynomolgus monkey, gibbon, orangutan, or marmoset. Generally, species variants have 70%, 75%, 80%, 85%, 90%, 91%, 92%, 93%, 94%, 95%, 96%, 97%, or 98% sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to or greater than 99%. The position of interest is then given the number assigned in the reference nucleic acid molecule. Alignment can be effected manually or by eye, particularly where sequence identity is greater than 80%.

As used herein, substantially pure means sufficiently homogeneous to appear free of readily detectable impurities, as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound can, however, be a mixture of stereoisomers or isomers. In such instances, further purification might increase the specific activity of the compound.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified PH20 polypeptide refers to preparations of PH20 proteins that are substantially free of cellular material, includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as contaminating proteins), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells. Viral vectors include, but are not limited to, adenoviral vectors, retroviral vectors and vaccinia virus vectors.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein, a conjugate refers to a modified PH20 polypeptide linked directly or indirectly to one or more other polypeptides or chemical moieties. Such conjugates include fusion proteins, those produced by chemical conjugates and those produced by any other method whereby at least one modified PH20 polypeptide is linked, directly or indirectly to another polypeptide or chemical moiety so long as the conjugate retains hyaluronidase activity. Exemplary of conjugates provided herein include PH20 polypeptides linked directly or indirectly to a multimerization domain (e.g. an Fc moiety), a toxin, a label or a drug.

As used herein, a fusion protein refers to a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids.

The protein product encoded by a fusion construct is referred to as a fusion polypeptide. Examples of fusion polypeptides include Fc fusions.

As used herein, a polymer that is conjugated to a modified PH20 polypeptide refers to any polymer that is covalently or otherwise stably linked, directly or via a linker, to such polypeptide. Such polymers, typically increase serum half-life, and include, but are not limited to, sialic moieties, polyethylene glycol (PEG) moieties, dextran, and sugar and other moieties, such as for glycosylation.

As used herein, the term assessing or determining is intended to include quantitative and qualitative determination in the sense of obtaining an absolute value for the activity of a product, and also of obtaining an index, ratio, percentage, visual or other value indicative of the level of the activity. Assessment can be direct or indirect.

As used herein, a "composition" refers to any mixture of two or more products or compounds. It can be a solution, a suspension, liquid, powder, a paste, aqueous, non-aqueous, or any combination thereof.

As used herein, a formulation refers to a composition containing at least one active pharmaceutical or therapeutic agent and one or more excipients.

As used herein, a co-formulation refers to a composition containing two or more active or pharmaceutical or therapeutic agents and one or more excipients. For example, a co-formulation of a fast-acting insulin and a hyaluronan degrading enzyme contains a fast-acting insulin, a hyaluronan degrading enzyme, and one or more excipients.

As used herein, "a combination" refers to any association between two or among more items or elements. Exemplary combinations include, but are not limited to, two or more pharmaceutical compositions, a composition containing two or more active ingredients, such as two modified PH20 polypeptides; a modified PH20 polypeptide and an anticancer agent, such as a chemotherapeutic compound; a modified PH20 polypeptide and a therapeutic agent (e.g. an insulin); a modified PH20 polypeptide and a plurality therapeutic and/or imaging agents, or any association thereof. Such combinations can be packaged as kits.

As used herein, a kit is a packaged combination, optionally, including instructions for use of the combination and/or other reactions and components for such use.

As used herein, "disease or disorder" refers to a pathological condition in an organism resulting from cause or condition including, but not limited to, infections, acquired conditions, genetic conditions, and characterized by identifiable symptoms.

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing a hyaluronan degrading enzyme, such as a hyaluronidase, for example, a soluble hyaluronidase, either alone or in combination with or in addition to another treatment and/or agent. Exemplary diseases and conditions, include, but are not limited to, hyaluronan-rich cancers, for example, tumors, including solid tumors such as late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Exemplary hyaluronan-associated diseases and conditions also are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a pharmaceutically effective agent or therapeutic agent includes any bioactive agent that can exhibit a therapeutic effect to treat a disease or disorder. Exemplary therapeutic agents are described herein. Therapeutic agents include, but are not limited to, anesthetics, vasoconstrictors, dispersing agents, conventional therapeutic drugs, including small molecule drugs, including, but not limited to, bisphosphonates, and therapeutic proteins, including, but not limited to, insulin, IgG molecules, antibodies, cytokines and coagulation factors.

As used herein, "insulin" refers to a hormone, precursor or a synthetic or recombinant analog thereof that acts to increase glucose uptake and storage and/or decrease endogenous glucose production. Insulin and analogs thereof are well known to one of skill in the art, including in human and allelic and species variants thereof. Insulin is translated as a precursor polypeptide designated preproinsulin (110 amino acid for human insulin), containing a signal peptide that directs the protein to the endoplasmic reticulum (ER) wherein the signal sequence is cleaved, resulting in proinsulin. Proinsulin is processed further to release a C- or connecting chain peptide (a 31 amino acid C-chain in human insulin). The resulting insulin contains an A-chain (21 amino acid in length in human insulin; set forth in SEQ ID NO:862) and a B-chain (30 amino acid in length in human insulin; set forth in SEQ ID NO:863) which are cross-linked by disulfide bonds. A fully cross-linked human insulin contains three disulfide bridges: one between position 7 of the A-chain and position 7 of the B-chain, a second between position 20 of the A-chain and position 19 of the B-chain, and a third between positions 6 and 11 of the A-chain. Reference to an insulin includes monomeric and multimeric insulins, including hexameric insulins, as well as humanized insulins. Exemplary insulin polypeptides are those of mammalian, including human, origin. Reference to insulin includes preproinsulin, proinsulin and insulin polypeptides in single-chain or two-chain forms, truncated forms thereof that have activity, and includes allelic variants and species variants of human insulin, variants encoded by splice variants, and other variants, such as insulin analogs. An exemplary insulin is human insulin having a sequence of amino acids of the A- and B-chains of human insulin are set forth in SEQ ID NOS: 862 and 863, respectively, and variants or analogs thereof that exhibit at least 80%, 85%, 90%, 91%, 92%, 93%, 94%, 95%, 96%, 97%, 98% or 99% sequence identity thereto to one or both of the A-chain or B-chain and that acts to increase glucose uptake and storage and/or decrease endogenous glucose production. A further exemplary insulin is porcine insulin having a sequence of amino acids for the preproinsulin as set forth in SEQ ID NO:864, whereby the A chain corresponds to amino acid residue positions 88-108 and the B-chain correspond to amino acid, and variants or analogs thereof that exhibit at least 80%, 85%, 90%, 91%, 92%, 93%, 94%, 95%, 96%, 97%, 98% or 99% sequence identity thereto to one or both of the A-chain or B-chain and that acts to increase glucose uptake and storage and/or decrease endogenous glucose production.

As used herein, "fast-acting insulin" refers to any insulin that exhibits peak insulin levels at or about not more than four hours following subcutaneous administration to a subject. Fast-acting insulins include any insulin or any fast-acting insulin composition for acute administration to a diabetic subject in response to an actual, perceived, or anticipated hyperglycemic condition in the subject arising at the time of, or within about four hours following, administration of the fast-acting insulin (such as a prandial hyperglycemic condition resulting or anticipated to result from, consumption of a meal), whereby the fast-acting insulin is able to prevent, control or ameliorate the acute hyperglycemic condition. Fast-acting insulins include recombinant insulins and isolated insulins (also referred to as "regular" insulins) such as the insulin sold as human insulin, porcine insulins and bovine insulins, as well as rapid acting insulin analogs (also termed fast-acting insulin analogs herein) designed to be rapid acting by virtue of amino acid changes. Exemplary regular insulin preparations include, but are not limited to, human regular insulins, such as those sold under the trademarks Humulin® R, Novolin® R and Velosulin®, Insulin Human, USP and Insulin Human Injection, USP, as well as acid formulations of insulin, such as, for example, Toronto Insulin, Old Insulin, and Clear Insulin, and regular pig insulins, such as Iletin II®(porcine insulin). Regular insulins typically have an onset of action of between 30 minutes to an hour, and a peak insulin level of 2-5 hours post administration.

As used herein, rapid acting insulin analogs (also called fast-acting insulin analogs) are insulins that have a rapid onset of action. Rapid insulins typically are insulin analogs that have been engineered, such as by the introduction of one or more amino acid substitutions, to be more rapid acting than regular insulins. Rapid acting insulin analogs typically have an onset of action of 10-30 minutes post injection, with peak insulin levels observed 30-90 minutes post injection. Exemplary rapid acting insulin analogs are analogs of human insulin containing one or more amino acid changes in the A-chain and/or B-chain of human insulin set forth in SEQ ID NO:862 or 863, respectively, and that exhibit an onset of action 10-30 minutes post injection with peak insulin levels observed 30-90 minutes post injection. Exemplary rapid acting insulin analogs include, but are not limited to, for example, insulin lispro (e.g., Humalog® insulin), insulin aspart (e.g., NovoLog® insulin), and insulin glulisine (e.g., Apidra® insulin) the fast-acting insulin composition sold as VIAject® and VIAtab®(see, e.g., U.S. Pat. No. 7,279,457). The amino acid sequence of exemplary rapid acting insulin analogs have an A chain with a sequence of amino acids set forth in SEQ ID NO:862 and a B chain having a sequence of amino acids set forth in any of SEQ ID NOS:865-867. Also included are any other insulins that have an onset of action of 30 minutes or less and a peak level before 90 minutes, typically 30-90 minutes, post injection.

As used herein, a human insulin refers to an insulin that is synthetic or recombinantly produced based upon the human polypeptide, including allelic variants and analogs thereof.

As used herein, fast-acting human insulins or human fast-acting insulin compositions include any human insulin or composition of a human insulin that is fast-acting, but excludes non-human insulins, such as regular pig insulin.

As used herein, the terms "basal-acting insulins," or "basal insulins" refer to insulins administered to maintain a basal insulin level as part of an overall treatment regimen for treating a chronic condition such diabetes. Typically, a basal-acting insulin is formulated to maintain an approximately steady state insulin level by the controlled release of insulin when administered periodically (e.g., once or twice daily). Basal-acting insulins include crystalline insulins (e.g., NPH and Lente®, protamine insulin, surfen insulin), basal insulin analogs (insulin glargine, HOE 901, NovoSol Basal) and other chemical formulations of insulin (e.g., gum arabic, lecithin or oil suspensions) that retard the absorption rate of regular insulin. As used herein, the basal-acting insulins can include insulins that are typically understood as long-acting (typically reaching a relatively low peak concentration, while having a maximum duration of action over about 20-30 hours) or intermediate-acting (typically causing peak insulin concentrations at about 4-12 hours after administration).

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing a disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation containing a single dose of therapeutic agent for direct administration. Single dosage formulations generally do not contain any preservatives.

As used herein, a multi-dose formulation refers to a formulation that contains multiple doses of a therapeutic agent and that can be directly administered to provide several single doses of the therapeutic agent. The doses can be administered over the course of minutes, hours, weeks, days or months. Multidose formulations can allow dose adjustment, dose-pooling and/or dose-splitting. Because multi-dose formulations are used over time, they generally contain one or more preservatives to prevent microbial growth.

As used herein, an "article of manufacture" is a product that is made and sold. As used throughout this application, the term is intended to encompass a therapeutic agent with a soluble PH20, such as esPH20, or an esPH20 alone, contained in the same or separate articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "control" or "standard" refers to a sample that is substantially identical to the test sample, except that it is not treated with a test parameter, or, if it is a plasma sample, it can be from a normal volunteer not affected with the condition of interest. A control also can be an internal control. For example, a control can be a sample, such as a virus, that has a known property or activity.

As used herein, the singular forms "a," "an" and "the" include plural referents unless the context clearly dictates otherwise. Thus, for example, reference to "an" agent includes one or more agents.

As used herein, the term "or" is used to mean "and/or" unless explicitly indicated to refer to alternatives only or the alternatives are mutually exclusive.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

For clarity of disclosure, and not by way of limitation, the detailed description is divided into the subsections that follow.

B. PH20 Hyaluronidase

Provided herein are modified PH20 polypeptides. PH20 (also known as sperm surface protein, sperm adhesion molecule 1 or SPAM1) is a hyaluronidase that hydrolyzes hyaluronan (also called hyaluronic acid, hyaluronate or HA) found in connective tissues such as the extracellular matrix. Hyaluronan polymers are composed of repeating disaccharide units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length, and polymers of hyaluronan can range in size from about 5,000 to 20,000,000 Da in vivo. Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. PH20 is an endo-β-N-acetyl-hexosaminidase that hydrolyzes the β1→4 glycosidic bond of hyaluronic acid into various oligosaccharide lengths such as tetrasaccharides and hexasaccharides. PH20 has both hydrolytic and transglycosidase activities. In addition to degrading hyaluronic acid, PH20 also can degrade chondroitin sulfates, such as C4-S and C6-S. PH20 can exhibit hyaluronidase activity at acidic pH and neutral pH.

1. Structure

PH20 cDNA has been cloned from numerous mammalian species. Exemplary PH20 precursor polypeptides include, but are not limited to, human (SEQ ID NO:6), bovine (SEQ ID NOS:15 or 17), rabbit (SEQ ID NO:23), Cynomolgus monkey (SEQ ID NO:13), guinea pig (SEQ ID NO:28), rat (SEQ ID NO:21), mouse (SEQ ID NO:19), chimpanzee (SEQ ID NO:8, SEQ ID NO:9 or SEQ ID NO:869) Rhesus monkey (SEQ ID NO:11), Fox (SEQ ID NO:30), Gibbon (SEQ ID NO:856), Marmoset (SEQ ID NO:858) or orangutan (SEQ ID NO:860) PH20 polypeptides. The mRNA transcript is typically translated to generate a precursor protein containing a 35 amino acid signal sequence at the N-terminus. Following transport to the ER, the signal peptide is removed to yield a mature PH20 polypeptide. Exemplary mature PH20 polypeptides include, but are not limited to, human (SEQ ID NO:7), bovine (SEQ ID NOS:16 or 18), rabbit (SEQ ID NO:24), Cynomolgus monkey (SEQ ID NO:14), guinea pig (SEQ ID NO:29), rat (SEQ ID NO:22), mouse (SEQ ID NO:20), chimpanzee (SEQ ID NO:10 or SEQ ID NO:870), Rhesus monkey (SEQ ID NO:12), Fox (SEQ ID NO:31), Gibbon (SEQ ID NO:857), Marmoset (SEQ ID NO:859) or orangutan (SEQ ID NO:861) PH20 polypeptides. For example, the human PH20 mRNA transcript is normally translated to generate a 509 amino acid precursor protein (SEQ ID NO:6) containing a 35 amino acid signal sequence at the N-terminus (amino acid residue positions 1-35 of SEQ ID NO:6). Thus, following transport to the ER and removal of the signal peptide, a 474 amino acid mature polypeptide with an amino acid sequence set forth in SEQ ID NO:7 is produced. Sequences of PH20 from ovine are also known (see e.g., SEQ ID NOS: 25-27).

In particular, human PH20 has the sequence of amino acids set forth in SEQ ID NO:6. The mature human PH20 lacking a signal sequence is set forth in SEQ ID NO:7. Allelic variants and other variants of PH20 are known. Other sequences of PH20 have been reported. For example, a PH20 variant is known as set forth in the precursor sequence set forth in SEQ ID NO:68 that contains an Ala at position 48 and a Trp at position 499, or the mature sequence thereof set forth in SEQ ID NO:69 containing the corresponding differences at positions 13 and 464, respectively, compared to the sequence set forth in SEQ ID NO:7 (see e.g., Gmachl et al. (1993) *FEBS Lett.*, 336:545-548; GenBank Accession No. AAC60607). Further, a natural variant of PH20 has been identified containing a Glutamine (Gln; Q) at position 5 as compared to the precursor sequence of amino acids set forth in SEQ ID NO:6 (see e.g., SEQ ID NO:70, see also Varela et al. (2011) *Nature*, 469:539-542). Another natural variant contains an Alanine (Ala; A) at position 47 compared to the sequence of amino acids set forth in SEQ ID NO:6 (as set forth in SEQ ID NO: 71) and corresponding to position 12 compared to the sequence of amino acids set forth in SEQ ID NO: 3 or 7 (as set forth in SEQ ID NO:72).

The sequence and structure of PH20 polypeptides is highly conserved. Sequence identity between and among PH20 proteins from various species is about 50% to 90%. The hydrophobic N-terminal signal sequence of 35 amino acids in length is generally conserved among PH20 hyaluronidase polypeptides. PH20 hyaluronidases contain a common core hyaluronidase domain region of about 340 amino acids in length that corresponds to amino acid residues 38-374 of the precursor human PH20 sequence set forth in SEQ ID NO:6. A mature PH20 polypeptide lacking the signal sequence and containing a contiguous sequence of amino acids having a C-terminal amino acid residue corresponding to amino acid residue 464 of SEQ ID NO:6 (e.g., amino acid residues corresponding to positions 36-464 of the amino acid sequence set forth in SEQ ID NO:6) is the minimal sequence required for hyaluronidase activity (see e.g., U.S. patent application Ser. No. 10/795,095, which is issued as U.S. Pat. No. 7,767,429; see also U.S. Publication No. US20100143457).

Within the common hyaluronidase domain region, at least 57 amino acids are conserved between and among species (see e.g., Arming et al. (1997) *Eur. J. Biochem.*, 247:810-814; ten Have et al. (1998) *Reprod. Fertil. Dev.*, 10:165-72; Chowpongpang et al. (2004) *Biotechnology Letters*, 26:1247-1252). For example, PH20 hyaluronidases contain 12 conserved cysteine residues corresponding to amino acid residue 25, 189, 203, 316, 341, 346, 352, 400, 402, 408, 423 and 429 of the sequence of amino acids of a mature PH20 lacking the signal sequence such as set forth in SEQ ID NO: 3 or 7 (corresponding to amino acid residues 60, 224, 238, 351, 376, 381, 387, 435, 437, 443, 458 or 464 of full-length human PH20 set forth in SEQ ID NO:6). Cysteine residues corresponding to 25 and 316 and cysteine residues corresponding to 189 and 203 form disulfide bridges. The other cysteine residues also form disulfide bridges, are involved in posttranslational protein maturation and/or in activity modulation. For example, further four disulfide bonds are formed between the cysteine residues C376 and C387; between C381 and C435; between C437 and C443; and between C458 and C464 of the polypeptide exemplified in SEQ ID NO:6 (corresponding to positions C341 and C352; between C346 and C400; between C402 and C408; and between C423 and C429 of the mature polypeptide set forth in SEQ ID NO:3 or 7, respectively).

Amino acid residues corresponding to amino acid residue D111, E113 and E249 of the sequence of amino acids set forth in SEQ ID NO: 3 or 7 are acidic residues part of the enzyme active site and are conserved between and among PH20 species. Amino acid residues R176, R246, R252 of the sequence of amino acids set forth in SEQ ID NO: 3 or 7 are also conserved between and among species and contribute to substrate binding and/or hyaluronidase activity. Amino acid mutations D111N, E113Q, R176G, E249N and R252T result in enzymes that have no detectable enzymatic activity or residual enzymatic activity (see e.g., Arming et al. (1997) *Eur. J. Biochem.*, 247:810-814).

The results herein confirm the requirement of PH20 amino acid residues corresponding to positions 25, 111, 113, 176, 189, 203, 246, 249, 252, 316, 341, 346, 352, 400, 402, 408, 423 and 429 of the sequence of amino acids set forth in a mature PH20 lacking the signal sequence such as set forth in SEQ ID NO: 3 or 7 for hyaluronidase activity, since mutagenesis of these residues results in an enzyme that is not active (e.g., it is not expressed or is inactive when expressed, see e.g., Tables 5 and 10). The exception is that amino acid replacement corresponding to R176K and C316D resulted in mutants that generated some residual hyaluronidase activity.

Glycosylation also is required for PH20 hyaluronidase activity based on the recognition motif NxS or NxT. There are six N-linked oligosaccharides at amino acid residues corresponding to positions N47, N131, N200, N219, N333 and N358 of the sequence of amino acids set forth in SEQ ID NO: 3 or 7 (corresponding to amino acid residues N82, N166, N235, N254, N368 and N393 of human PH20 set forth in SEQ ID NO: 6). In particular, at least N-linked glycosylation sites corresponding to amino acid residues N200, N333 and N358 are required for secretion and/or activity of the enzyme (see e.g., U.S. Publication No. US20100143457). For example, a PH20 polypeptide containing amino acid mutations N200A, N333A, N358A or N333A/N393A result in inactive proteins. Single mutations of glycosylation sites N47A, N131A, N219A, N47A/N131A, N47A/N219A, N131A/N291A retain activity. The N-linked glycosylation site corresponding to amino acid residue N368 of human PH20 set forth in SEQ ID NO:6 is conserved between and among species (see e.g., Chowpongpang et al. (2004) *Biotechnology Letters*, 26:1247-1252). PH20 hyaluronidases also contains O-linked glycosylation sites. For example, human PH20 has one O-linked oligosaccharide at the amino acid residue corresponding to amino acid T440 of the sequence of amino acids set forth in SEQ ID NO:3 or 7 (corresponding to amino acid residue T475 in SEQ ID NO:6).

In addition to the catalytic sites, PH20 also contains a hyaluronan-binding site. This site is located in the Peptide 2 region, which corresponds to amino acid positions 205-235 of the precursor polypeptide set forth in SEQ ID NO:6 and positions 170-200 of the mature polypeptide set forth in SEQ ID NO:3 or 7. This region is highly conserved among hyaluronidases and is similar to the heparin binding motif. Mutation of the arginine residue at position 176 (corresponding to the mature PH20 polypeptide set forth in SEQ ID NO:3 or 7) to a glycine results in a polypeptide with only about 1% of the hyaluronidase activity of the wild type polypeptide (Arming et al., (1997) *Eur. J. Biochem.* 247: 810-814).

PH20 polypeptides contain a glycosyl phosphatidylinositol (GPI) anchor attached to the C-terminus of the protein that anchors the protein to the extracellular leaflet of the plasma membrane of cells. At least human, monkey, mouse and guinea pig PH20 are strongly attached to the plasma membrane via the GPI anchor, which can be released by treating with phosphatidylinositol-specific phospholipase C (PI-PLC; see e.g., Lin et al. (1994) *Journal of Cell Biology*, 125:1157-1163; Lin et al. (1993) *Proc. Natl. Acad. Sci.*, 90:10071-10075). Other PH20 enzymes, such as bovine PH20, are loosely attached to the plasma membrane and are not anchored via a phospholipase sensitive anchor. As discussed below, soluble active forms that, when expressed, are not attached to the membrane but are secreted can be generated by removal of all of a portion of the GPI anchor attachment signal site (see also U.S. Pat. No. 7,767,429; U.S. Publication No. US20100143457). These include, for example, soluble PH20 polypeptides set forth in any of SEQ ID NOS: 3 or 32-66, or precursor forms thereof containing a signal sequence.

GPI-anchored proteins, for example human PH20, are translated with a cleavable N-terminal signal peptide that directs the protein to the endoplasmic reticulum (ER). At the C-terminus of these proteins is another signal sequence that directs addition of a preformed GPI-anchor to the polypeptide within the lumen of the ER. Addition of the GPI anchor occurs following cleavage of the C-terminal portion at a specific amino acid position, called the ω-site (typically located approximately 20-30 amino acids from the C-terminus). Although there appears to be no consensus sequence to identify the location of the ω-site, GPI anchored proteins contain a C-terminal GPI-anchor attachment signal sequence or domain that typically contains a predominantly hydrophobic region of 8-20 amino acids, preceded by a hydrophilic spacer region of 8-12 amino acids immediately downstream of the ω-site. This hydrophilic spacer region often is rich in charged amino acids and proline (White et al. (2000) *J. Cell Sci.* 113 (Pt. 4): 721-727). There is generally a region of approximately 11 amino acids before the ω-1 position that is characterized by a low amount of predicted secondary structure, a region around the cleavage site (ω-site), from ω-1 to ω+2 that is characterized by the presence of small side chain residues, the spacer region between positions ω+3 and ω+9, and a hydrophobic tail from ω+10 to the C-terminal end (Pierleoni et al., (2008) *BMC Bioinformatics* 9:392).

Although there is no GPI-anchor attachment signal consensus sequence, various in silico methods and algorithms have been developed that can be used to identify such sequences in polypeptides (see, e.g., Udenfriend et al. (1995) *Methods Enzymol.* 250:571-582; Eisenhaber et al. (1999) *J. Mol. Chem.* 292:741-758; Kronegg and Buloz, (1999), "Detection/prediction of GPI cleavage site (GPI-anchor) in a protein (DGPI)," 129.194.185.165/dgpi/; Fankhauser et al. (2005) *Bioinformatics* 21:1846-1852; Omaetxebarria et al. (2007) *Proteomics* 7:1951-1960; Pierleoni et al. (2008) *BMC Bioinformatics* 9:392), including those that are readily available on bioinformatic websites, such as the ExPASy Proteomics tools site (expasy.ch/tools/). Thus, one of skill in the art can determine whether a PH20 polypeptide likely contains a GPI-anchor attachment signal sequence, and, therefore, whether the PH20 polypeptide is a GPI-anchored protein.

The covalent attachment of a GPI-anchor to the C-terminus of human PH20 and, therefore, the membrane-bound nature of PH20, has been confirmed using phosphatidylinositol-specific phospholipase C (PI-PLC) hydrolysis studies (see e.g., Lin et al, (1994) *J. Biol. Chem.* 125:1157-1163). Phosphatidylinositol-specific phospholipase C (PI-PLC) and D (PI-PLD) hydrolyze the GPI anchor, releasing the PH20 polypeptide from the cell membrane. The prior art literature reports that a ω-site cleavage site of human PH20 is identified between Ser-490 and Ala-491 and for monkey PH20 is identified between Ser491 and Thr492 (Lin et al. (1993) *Proc. Natl. Acad. Sci,* (1993) 90:10071-10075). Thus, the literature reports that a GPI-anchor attachment signal sequence of human PH20 is located at amino acid positions 491-509 of the precursor polypeptide set forth in SEQ ID NO:6, and the ω-site is amino acid position 490. Thus, in this modeling of human PH20, amino acids 491-509 are cleaved following transport to the ER and a GPI anchor is covalently attached to the serine residue at position 490.

2. Function

PH20 is normally expressed in sperm from a single testis-specific gene. PH20 is a sperm-associated protein involved in fertilization. PH20 is normally localized on the sperm surface, and in the lysosome-derived acrosome, where it is bound to the inner acrosomal membrane. PH20 is multifunctional and exhibits hyaluronidase activity, hyaluronan (HA)-mediated cell-signaling activity, and acts as a sperm receptor for the zona pellucida surrounding the oocyte when present on acrosome reacted (AR) sperm. For example, PH20 is naturally involved in sperm-egg adhesion and aids penetration by sperm of the layer of cumulus cells by digesting hyaluronic acid. In addition to being a hyaluronidase, PH20 also appears to be a receptor for HA-induced cell signaling, and a receptor for the zona pellucida surrounding the oocyte. Due to the role of PH20 in fertilization, PH20 can be used as an antigen for immunocontraception.

PH20 is a neutral active hyaluronidase, although it can exhibit acid-active activity in some cases. The hyaluronidase activity of PH20 is exhibited by the plasma membrane- and inner acrosomal membrane-associated PH20. The plasma membrane PH20 exhibits hyaluronidase activity only at neutral pH, while the inner acrosomal membrane-associated PH20 exhibits acid-active enzyme activity. The structural basis for these differences is due to the presence of two catalytic sites in PH20. A first catalytic site is designated the Peptide 1 region, corresponding to amino acid residues 142-172 of SEQ ID NO:6, which is involved in enzyme activity of PH20 at neutral pH. A second catalytic site is designated the peptide 3 region, corresponding to amino acid residues 277-297 of SEQ ID NO:6, which is involved in enzyme activity at lower pH. A change in the structure of the inner acrosomal membrane-associated PH20 occurs after the acrosome reaction, whereby PH20 is endoproteolytically cleaved but held together by disulfide bonds. The result of the endoproteolysis is that the peptide 3 region is activated and can thus effect neutral and acid-activity to PH20 (see e.g., Cherr et al. (2001) *Matrix Biology*, 20:515-525. Also, after the acrosome reaction, lower molecular weight forms are generated by release from the inner acrosomal membrane (e.g., a 53 kDa soluble form of PH20 is generated in monkey). The lower molecular weight form(s) also is acid active.

The hyaluronidase activity of PH20 accounts for the spreading activity observed in animal testes extracts that have been used clinically for decades to increase the dispersion and absorption of drugs (see e.g., Bookbinder et al. (2006) *J Controlled Release,* 114:230-241). For example, pharmaceutical preparations containing hyaluronidase were developed as fractionated extracts from bovine testes for therapeutic use as spreading agents and in other applications (Schwartzman (1951) *J. Pediat.,* 39:491-502). Original bovine testicular extract preparations included, for example, extracts sold under the trademarks Wydase®, Hylase®, "Dessau," Neopermease®, Alidase® and Hyazyme®. It is now known that the spreading activity of testicular extract preparations are due to PH20 hyaluronidase activity. For example, in 2001 a sperm hyaluronidase in bull was identified as the hyaluronidase PH20 (Lalancette et al. (2001) *Biol. Reprod.,* 65:628-36). By catalyzing the hydrolysis of hyaluronic acid, PH20 hyaluronidase lowers the viscosity of hyaluronic acid, thereby increasing tissue permeability. Hence, soluble forms of PH20 are used as a spreading or dispersing agent in conjunction with other agents, drug and proteins to enhance their dispersion and delivery, and to improve the pharmacokinetic and pharmacodynamic profile of the coadministered agent, drug or protein (see e.g., U.S. Pat. No. 7,767,429; Bookbinder et al. (2006) *J Controlled Release,* 114:230-241).

3. Soluble PH20 Polypeptides

PH20 can exist in membrane-bound or membrane-associated form, or can be secreted into the media when expressed from cells, and thereby can exist in soluble form. Soluble PH20 can be detected and discriminated from insoluble, membrane-bound PH20 using methods well known in the art, including, but not limited to, those using a Triton® X-114 assay. In this assay, soluble PH20 hyaluronidases partition into the aqueous phase of a Triton®

X-114 solution warmed to 37° C. (Bordier et al., (1981) *J. Biol. Chem.*, 256:1604-7) while membrane-anchored PH20 hyaluronidases partition into the detergent rich phase. Thus, in addition to using algorithms to assess whether a PH20 polypeptide is naturally GPI-anchored and hence membrane-bound, solubility experiments also can be performed.

Soluble PH20 enzymes include hyaluronidases that contain a GPI-anchor attachment signal sequence, but that are loosely attached to the membrane such that they do not contain a phospholipase sensitive anchor. For example, soluble PH20 polypeptides include ovine or bovine PH20. Various forms of such soluble PH20 hyaluronidases have been prepared and approved for therapeutic use in subjects, including humans. For example, animal-derived hyaluronidase preparations include Vitrase® (ISTA Pharmaceuticals), a purified ovine testicular hyaluronidase, and Amphadase® (Amphastar Pharmaceuticals), a bovine testicular hyaluronidase. Soluble PH20 enzymes also include truncated forms of non-human or human membrane-associated PH20 hyaluronidases that lack one or more amino acid residues of a glycosylphosphatidylinositol (GPI) anchor attachment signal sequence and that retain hyaluronidase activity (see e.g., U.S. Pat. No. 7,767,429; U.S. Publication No. US20100143457). Thus, instead of having a GPI-anchor covalently attached to the C-terminus of the protein in the ER and being anchored to the extracellular leaflet of the plasma membrane, these polypeptides are secreted when expressed from cells and are soluble. In instances where the soluble hyaluronan degrading enzyme retains a portion of the GPI anchor attachment signal sequence, 1, 2, 3, 4, 5, 6, 7, 8, 9, 10 or more amino acid residues in the GPI-anchor attachment signal sequence can be retained, provided the polypeptide is soluble (i.e., secreted when expressed from cells) and active.

Exemplary soluble hyaluronidases that are C-terminally truncated and lack all or a portion of the GPI anchor attachment signal sequence include, but are not limited to, PH20 polypeptides of primate origin, such as, for example, human and chimpanzee PH20 polypeptides. For example, soluble PH20 polypeptides can be made by C-terminal truncation of a polypeptide set forth in SEQ ID NOS:7, 10, 12, 14, 69, 72, 857, 859, 861 or 870 or variants thereof that exhibit at least 80%, 85%, 90%, 95% or more sequence identity to any of SEQ ID NO: 7, 10, 12, 14, 69, 72, 857, 859, 861 or 870, wherein the resulting polypeptide is active, soluble and lacks all or a portion of amino acid residues from the GPI-anchor attachment signal sequence.

Exemplary soluble PH20 polypeptides are C-terminal truncated human PH20 polypeptides that are mature (lacking a signal sequence), soluble and exhibit neutral activity, and that contain a contiguous sequence of amino acids set forth in SEQ ID NO:6 or SEQ ID NO:7 that minimally has a C-terminal truncated amino acid residue at or after amino acid residue 464 of the sequence of amino acids set forth in SEQ ID NO:6. For example, soluble PH20 polypeptides include C-terminal truncated polypeptides that minimally contain a contiguous sequence of amino acids 36-464 of SEQ ID NO:6, or includes a sequence of amino acids that has at least 85%, for example at least 86%, 87%, 88%, 89%, 90%, 91%, 92%, 93%, 94%, 95%, 96%, 97%, 98% sequence identity to a contiguous sequence of amino acids that has a C-terminal amino acid residue after amino acid 464 of SEQ ID NO:6 and retains hyaluronidase activity. Exemplary C-terminally truncated human PH20 polypeptides are mature polypeptides (lacking a signal sequence) that include a contiguous sequence of amino acids set forth in SEQ ID NO:6 with a C-terminal residue after 464 such as after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:6, or a variant thereof that exhibits at least 85% sequence identity, such as at least 86%, 87%, 88%, 89%, 90%, 91%, 92%, 93%, 94%, 95%, 96%, 97%, 98% sequence identity thereto and retains hyaluronidase activity. For example, exemplary C-terminal PH20 polypeptides have a sequence of amino acids 36 to 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:6, or a variant thereof that exhibits at least 85% sequence identity, such as at least 86%, 87%, 88%, 89%, 90%, 91%, 92%, 93%, 94%, 95%, 96%, 97%, 98% sequence identity thereto and retains hyaluronidase activity. Soluble PH20 polypeptides include any that has the sequence of amino acids set forth in SEQ ID NOS: 3 or 32-66 or a sequence of amino acids that exhibits at least 85% sequence identity, such as at least 86%, 87%, 88%, 89%, 90%, 91%, 92%, 93%, 94%, 95%, 96%, 97%, 98% sequence identity to the sequence of amino acids set forth in any of SEQ ID NOS: 3 or 32-66.

In particular, a soluble human PH20 polypeptide is a polypeptide that is truncated after amino acid 482 of the sequence set forth in SEQ ID NO:6. Such a polypeptide can be generated from a nucleic acid molecule containing a signal sequence and encoding amino acids 36-482, for example, as set forth in SEQ ID NO: 1 (containing an IgG kappa signal sequence) or SEQ ID NO:67 (containing the native signal sequence). Post translational processing removes the signal sequence, leaving a 447 amino acid soluble recombinant human PH20 (SEQ ID NO:3). A product produced upon expression of a vector set forth in SEQ ID NO:4 or 5, and containing a nucleic acid molecule set forth in SEQ ID NO:67, results in a secreted product, designated rHuPH20, in the culture medium that exhibits heterogeneity at the C-terminus such that the product includes a mixture of species that can include any one or more of SEQ ID NOS: 3 and 44-48 in various abundance. Typically, rHuPH20 is produced in cells that facilitate correct N-glycosylation to retain activity, such as mammalian cells, for example CHO cells (e.g., DG44 CHO cells). Hylenex® (Halozyme) is a human recombinant hyaluronidase produced by genetically engineered Chinese Hamster Ovary (CHO) cells containing nucleic acid encoding a truncated human PH20 polypeptide (designated rHuPH20).

C. Modified PH20 Polypeptides

Provided herein are modified or variant PH20 polypeptides. The modified PH20 polypeptides provided herein exhibit altered activities or properties compared to a wild-type, native or reference PH20 polypeptide. Included among the modified PH20 polypeptides provided herein are PH20 polypeptide that are active mutants, whereby the polypeptides exhibit at least 40% of the hyaluronidase activity of the corresponding PH20 polypeptide not containing the amino acid modification (e.g., amino acid replacement). In particular, provided herein are PH20 polypeptides that exhibit hyaluronidase activity and that exhibit increased stability compared to the PH20 not containing the amino acid modification. Also provided are modified PH20 polypeptides that are inactive, and that can be used, for example, as antigens in contraception vaccines.

The modifications can be a single amino acid modification, such as single amino acid replacements (substitutions), insertions or deletions, or multiple amino acid modifications, such as multiple amino acid replacements, insertions or deletions. Exemplary modifications are amino acid replacements, including single or multiple amino acid replacements. The amino acid replacement can be a conservative substitution, such as set forth in Table 2, or a non-conservative substitution, such as any described herein. Modified PH20 polypeptides provided herein can contain at least or 1, 2, 3, 4, 5, 6, 7, 8, 9, 10, 11, 12, 13, 14, 15, 16, 17, 18, 19, 20, or more modified positions compared to the PH20 polypeptide not containing the modification.

The modifications described herein can be in any PH20 polypeptide, including, including precursor, mature, or C-terminal truncated forms, so long as the modified form exhibits hyaluronidase activity. For example, the PH20 polypeptides contain modifications compared to a wildtype, native or reference PH20 polypeptide set forth in any of SEQ ID NOS: 2, 3, 6-66, 68-72, 856-861, 869 or 870, or in a polypeptide that has a sequence of amino acids that is at least 65%, 70%, 75%, 80%, 85%, 86%, 87%, 88%, 89%, 90%, 91%, 92%, 93%, 94%, 95%, 96%, 97%, 98%, 99% identical to any of SEQ ID NOS: 3, 6-66, 68-72, 856-861, 869 or 870. For example, the modifications are made in a human PH20 polypeptide having the sequence of amino acids including or set forth in SEQ ID NO: 7, SEQ ID NO:69 or SEQ ID NO:72; a bovine PH20 polypeptide having a sequence of amino acids including or set forth in SEQ ID NOS:16 or 18; a rabbit PH20 polypeptide having a sequence of amino acids including or set forth in SEQ ID NO:24; a Cynomolgus monkey PH20 polypeptide having a sequence of amino acids including or set forth in SEQ ID NO:14; a guinea pig PH20 polypeptide having a sequence of amino acids including or set forth in SEQ ID NO:29; a rat PH20 polypeptide having a sequence of amino acids including or set forth in SEQ ID NO:22; a mouse PH20 polypeptide having a sequence of amino acids including or set forth in SEQ ID NO:20; a chimpanzee PH20 polypeptide having a sequence of amino acids including or set forth in SEQ ID NO:10 or 870; a Rhesus monkey PH20 polypeptide having a sequence of amino acids including or set forth in SEQ ID NO:12; a Fox PH20 polypeptide having a sequence of amino acids including or set forth in SEQ ID NO:31; a Gibbon PH20 polypeptide having a sequence of amino acids including or set forth in SEQ ID NO:857; a Marmoset PH20 polypeptide having a sequence of amino acids including or set forth in SEQ ID NO: 859; an Orangutan PH20 polypeptide having a sequence of amino acids including or set forth in SEQ ID NO:861; or a sheep PH20 polypeptide having a sequence of amino acids including or set forth in any of SEQ ID NOS: 25-27; or in sequence variants or truncated variants that exhibit at least 65%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 7, 10, 12, 14, 16, 18, 20, 22, 24-27, 29, 31, 69, 72, 857, 859, 861 or 870.

In particular, provided herein are PH20 polypeptides that contain modifications compared to a PH20 polypeptide set forth in SEQ ID NO: 3, 7, 32-66, 69 or 72, or a polypeptide that has a sequence of amino acids that is at least 68%, 70%, 75%, 80%, 85%, 86%, 87%, 88%, 89%, 90%, 91%, 92%, 93%, 94%, 95%, 96%, 97%, 98%, 99% identical to any of SEQ ID NOS: 3, 7, 32-66, 69 or 72. For example, the modifications provided herein also can be made in a PH20 polypeptide set forth as SEQ ID NO: 10, 12, 14, 24, 857, 859, 861 or 870.

In particular, provided herein are modified soluble PH20 polypeptides that are PH20 polypeptides containing a modification provided herein, and that when expressed from cells are secreted into the media as a soluble protein. For example, the modifications are made in a soluble PH20 polypeptide that is C-terminally truncated within or near the C-terminus portion containing the GPI-anchor signal sequence of a PH20 polypeptide that contains a GPI-anchor signal sequence. The C-terminal truncation can be a truncation or deletion of 8 contiguous amino acids at the C-terminus, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more amino acids at the C-terminus, so long as the resulting C-terminally truncated polypeptide exhibits hyaluronidase activity and is secreted from cells (e.g., into the media) when expressed. In some examples, the modifications provided herein are made in a soluble PH20 polypeptide that is a C-terminally truncated polypeptide of SEQ ID NO:7, 10, 12, 14, 69, 72, 857, 859, 861 or 870 or a variant thereof that exhibits at least 70%, 75%, 80%, 85%, 86%), 87%, 88%, 89%, 90%, 91%, 92%, 93%, 94%, 95%, 96%, 97%, 98%, 99% or more sequence identity to any of SEQ ID NOS: 7, 10, 12, 14, 69, 72, 857, 859, 861 or 870. In particular, the modifications provided herein are made in a soluble or C-terminally truncated human PH20 polypeptide having the sequence of amino acids set forth in SEQ ID NOS: 3 or 32-66 or a sequence of amino acids that exhibits at least 70%, 75%, 80%, 85%, 86%, 87%, 88%, 89%, 90%, 91%, 92%, 93%, 94%, 95%, 96%, 97%, 98% sequence identity to the sequence of amino acids set forth in any of SEQ ID NOS: 3 or 32-66. For example, modified PH20 polypeptides provided herein contain amino acid replacements or substitutions, additions or deletions, truncations or combinations thereof with reference to the PH20 polypeptide set forth in SEQ ID NO:3.

Modifications also can be made in the corresponding precursor form containing a signal peptide of any of SEQ ID NOS: 3, 7, 10, 12, 14, 16, 18, 20, 22, 24-27, 29, 31, 32-66, 69, 72, 857, 859, 861 or 870. For example, modifications provided herein can be made in a precursor form set forth in any of SEQ ID NOS: 2, 6, 8, 9, 11, 13, 15, 17, 19, 21, 23, 28, 30, 856, 858, 860 or 869 or in a variant thereof that exhibits at least 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 2, 6, 8, 9, 11, 13, 15, 17, 19, 21, 23, 28, 30, 856, 858, 860 or 869.

In examples of modified PH20 polypeptides provided herein, the modified PH20 polypeptide does not contain the sequence of amino acids set forth in any of SEQ ID NOS: 3-66, 68-72, 856-861, 869 or 870. Typically, the modified PH20 polypeptide is a human PH20 polypeptide, and does not contain the sequence of amino acids set forth in any of SEQ ID NOS: 8-31, 856-861, 869 or 870.

Generally, any modification, such as amino acid replacement, deletion or substitution, can be made in a PH20 polypeptide, with the proviso that the modification is not an amino acid replacement where the only modification is a single amino acid replacement that is V12A, N47A, D111N, E113Q, N131A, R176G, N200A, N219A, E249Q, R252T, N333A or N358A. Also, where the modified PH20 polypeptide contains only two amino acid replacements, the amino acid replacements are not P13A/L464W, N47A/N131A, N47A/N219A, N131A/N219A or N333A/N358A. In a further example, where the modified PH20 polypeptide contains only three amino acid replacements, the amino acid replacements are not N47A/N131A/N219A. Exemplary modifications provided herein are described in detail below.

For purposes herein, reference to positions and amino acids for modification herein, including amino acid replacement or replacements, are with reference to the PH20 polypeptide set forth in SEQ ID NO:3. It is within the level of one of skill in the art to make any of the modifications provided herein in another PH20 polypeptide by identifying the corresponding amino acid residue in another PH20 polypeptide, such as any set forth in SEQ ID NOS: 6, 7, 8, 9, 10, 11, 12, 13, 14, 15, 16, 17, 18, 19, 20, 21, 22, 23, 24-27, 28, 29, 30, 31, 32-66, 68-72, 856, 857, 858, 859, 860, 861, 869 or 870 or a variant thereof that exhibits at least 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 6, 7, 8, 9, 10, 11, 12, 13, 14, 15, 16, 17, 18, 19, 20, 21, 22, 23, 24-27, 28, 29, 30, 31, 32-66, 68-72, 856, 857, 858, 859, 860, 861, 869 or 870. Corresponding positions in another PH20 polypeptide can be identified by alignment of the PH20 polypeptide with the reference to the PH20 polypeptide set forth in SEQ ID NO:3. For example, FIG. 2 (A-L) depicts alignment of exemplary PH20 polypeptides with SEQ ID NO:3, and identification of exemplary corresponding positions. Also, since SEQ ID NOS: 3, 7, 32-66, 69 and 72 are all forms of a mature human PH20 with a different C-terminal amino acid residue, the numbering of amino acid residues in any of SEQ ID NOS: 7, 32-66, 69 and 72 is the same as SEQ ID NO:3, and hence the corresponding residues of each are identical to that set forth in SEQ ID NO:3 (see e.g., FIG. 1). Further, SEQ ID NOS set forth in any of SEQ ID NOS: 2, 6, 70 or 71 are precursor forms thereof that differ by only the presence of a signal sequence. For purposes of modification (e.g., amino acid replacement), the corresponding amino acid residue can be any amino acid residue, and need not be identical to the residue set forth in SEQ ID NO:3. Typically, the corresponding amino acid residue identified by alignment with residues in SEQ ID NO:3 is an amino acid residue that is identical to SEQ ID NO:3, or is a conservative or semi-conservative amino acid residue thereto (see e.g., FIGS. 2A-2L). It is also understood that the exemplary replacements provided herein can be made at the corresponding residue in a PH20 polypeptide, so long as the replacement is different than exists in the unmodified form of the PH20 polypeptide. Based on this description and the description elsewhere herein, it is within the level of one of skill in the art to generate a modified PH20 polypeptide containing any one or more of the described mutation, and test each for a property or activity as described herein.

Modifications in a PH20 polypeptide also can be made to a PH20 polypeptide that also contains other modifications, including modifications of the primary sequence and modifications not in the primary sequence of the polypeptide. For example, modifications described herein can be in a PH20 polypeptide that is a fusion polypeptide or chimeric polypeptide. The modified PH20 polypeptides provided herein also include polypeptides that are conjugated to a polymer, such as a PEG reagent.

Also provided herein are nucleic acid molecules that encode any of the modified PH20 polypeptides provided herein. In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in mammalian or human cells, bacteria or yeast, including for example *E. coli* or *Saccharomyces cerevisiae*. For example, codon usage information is available from the Codon Usage Database available at kazusa.or.jp.codon (see Richmond (2000) Genome Biology, 1:reports241 for a description of the database). See also, Forsburg (1994) Yeast, 10:1045-1047; Brown et al. (1991) Nucleic Acids Research, 19:4298; Sharp et al. (1988) Nucleic Acids Res., 12:8207-8211; Sharp et al. (1991) Yeast, 657-78). In some examples, the encoding nucleic acid molecules also can be modified to contain a heterologous signal sequence to alter (e.g., increased) expression and secretion of the polypeptide. Exemplary of a heterologous signal sequence is a nucleic acid encoding the IgG kappa signal sequence (set forth in SEQ ID NO:868).

The modified polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. For example, nucleic acid molecules encoding a PH20 polypeptide can be subjected to mutagenesis, such as random mutagenesis of the encoding nucleic acid, error-prone PCR, site-directed mutagenesis, overlap PCR, gene shuffling, or other recombinant methods. The nucleic acid encoding the polypeptides can then be introduced into a host cell to be expressed heterologously. Hence, also provided herein are nucleic acid molecules encoding any of the modified polypeptides provided herein. In some examples, the modified PH20 polypeptides are produced synthetically, such as using solid phase or solutions phase peptide synthesis.

In the subsections below, exemplary modified PH20 polypeptide exhibiting altered properties and activities, and encoding nucleic acid molecules, provided herein are described.

1. Active Mutants

Provided herein are modified PH20 polypeptides that contain one or more amino acid replacements in a PH20 polypeptide and that exhibit hyaluronidase activity. The modified PH20 polypeptides can exhibit 40% to 5000% of the hyaluronidase activity of a wildtype or reference PH20 polypeptide, such as the polypeptide set forth in SEQ ID NOS: 3 or 7. For example, modified PH20 polypeptides provided herein exhibit at least 40% of the hyaluronidase activity, such as at least 50%, 60%, 70%, 80%, 90%, 100%, 120%, 130%, 140%, 150%, 160%, 170%, 180%, 190%, 200%, 300%, 400%, 500%, 600%, 700%, 800%, 900%, 1000%), 2000%, 3000% or more of the hyaluronidase activity of a wildtype or reference PH20 polypeptide, such as the corresponding polypeptide not containing the amino acid modification (e.g., amino acid replacement), for example, a polypeptide set forth in SEQ ID NO:3 or 7. For example, exemplary positions that can be modified, for example by amino acid replacement or substitution, include, but are not limited to, any of positions corresponding to position 1, 2, 3, 4, 5, 6, 8, 9, 10, 11, 12, 13, 14, 15, 20, 22, 23, 24, 26, 27, 28, 29, 30, 31, 32, 33, 34, 35, 36, 37, 38, 39, 40, 41, 42, 43, 44, 45, 46, 47, 48, 49, 50, 51, 52, 54, 58, 59, 60, 61, 63, 65, 66, 67, 68, 69, 70, 71, 72, 73, 74, 75, 77, 79, 81, 82, 83, 84, 85, 86, 87, 89, 90, 91, 92, 93, 94, 96, 97, 98, 99, 102, 103, 104, 105, 106, 107, 108, 110, 114, 117, 118, 119, 120, 122, 124, 125, 127, 128, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 186, 192, 193, 195, 196, 197, 198, 200, 202, 204, 205, 206, 208, 209, 211, 212, 213, 214, 215, 216, 217, 218, 219, 220, 221, 222, 224, 226, 230, 231, 232, 233, 234, 235, 236, 237, 238, 239, 240, 242, 245, 247, 248, 251, 253, 255, 256, 257, 258, 259, 260, 261, 263, 264, 265, 266, 267, 269, 270, 271, 272, 273, 274, 275, 276, 277, 278, 279, 280, 282, 283, 284, 285, 286, 287, 288, 289, 290, 291, 292, 293, 294, 297, 298, 300, 301, 302, 304, 305, 306, 307, 308, 309, 310, 311, 312, 313, 314, 315, 316, 317, 318, 320, 321, 323, 324, 325, 326, 327, 328, 331, 334, 335, 338, 339, 342, 343, 347, 348, 349, 351, 353, 356, 357, 358, 359, 360, 361, 367, 368, 369, 371, 373, 374, 375, 376, 377, 378, 379, 380, 381, 383, 385, 387, 388, 389, 391, 392, 393, 394, 395, 396, 397, 398, 399, 401, 403, 404, 405, 406, 407, 409, 410, 411, 412, 413, 414, 415, 416, 417, 418, 419, 420, 421, 422, 425, 426, 427, 428, 431, 432, 433, 434, 435, 436, 437, 438, 439, 440, 441, 442, 443, 444, 445, 446 or 447 with reference to amino acid positions set forth in SEQ ID NO:3. Typically, the amino acid residue that is modified (e.g., replaced with another amino acid) at the position corresponding to any of the above positions in a PH20 polypeptide is an identical residue, a conservative residue or a semi-conservative amino acid residue to the amino acid residue set forth in SEQ ID NO:3.

To retain hyaluronidase activity, modifications typically are not made at those positions that are less tolerant to change or required for hyaluronidase activity. For example, generally modifications are not made at a position corresponding to position 7, 16, 17, 18, 19, 21, 25, 53, 55, 56, 57, 62, 64, 76, 78, 80, 88, 95, 100, 101, 109, 111, 112, 113, 115, 116, 121, 123, 126, 129, 185, 187, 188, 189, 190, 191, 194, 199, 201, 203, 207, 210, 223, 225, 227, 228, 229, 241, 243, 244, 246, 249, 250, 252, 254, 262, 268, 295, 296, 299, 303, 319, 322, 329, 330, 332, 333, 336, 337, 340, 341, 344, 345, 346, 350, 352, 354, 355, 362, 363, 364, 365, 366, 370, 372, 382, 384, 386, 390, 400, 402, 408, 423, 424, 429, 430, with reference to amino acid positions set forth in SEQ ID NO:3. Also, in examples where modifications are made at any of positions 2, 3, 4, 5, 6, 8, 9, 10, 11, 12, 13, 14, 15, 20, 22, 23, 27, 33, 34, 35, 36, 37, 38, 39, 40, 41, 42, 43, 44, 45, 46, 47, 48, 49, 50, 51, 52, 54, 58, 59, 60, 61, 63, 65, 66, 67, 68, 69, 70, 71, 72, 73, 74, 75, 77, 79, 81, 82, 83, 84, 85, 86, 87, 89, 90, 91, 92, 94, 96, 98, 99, 102, 103, 104, 105, 106, 107, 108, 110, 114, 117, 118, 119, 122, 124, 125, 127, 128, 130, 131, 132, 133, 134, 135, 136, 137, 138, 139, 143, 144, 145, 149, 150, 152, 153, 154, 155, 156, 157, 158, 159, 161, 163, 164, 165, 166, 167, 168, 169, 170, 171, 172, 173, 174, 175, 176, 177, 178, 179, 180, 181, 182, 183, 184, 186, 192, 193, 195, 197, 198, 200, 202, 204, 206, 208, 209, 211, 212, 213, 214, 215, 216, 217, 218, 219, 220, 221, 222, 224, 226, 230, 231, 232, 233, 234, 235, 236, 238, 239, 240, 242, 245, 247, 248, 251, 253, 255, 256, 257, 258, 260, 261, 263, 264, 265, 266, 267, 269, 270, 271, 272, 273, 274, 275, 276, 278, 279, 280, 282, 283, 284, 285, 286, 287, 288, 289, 290, 291, 292, 293, 294, 297, 298, 300, 301, 302, 304, 305, 306, 307, 308, 310, 311, 312, 313, 314, 315, 316, 317, 318, 320, 321, 323, 324, 325, 326, 327, 331, 334, 335, 338, 339, 342, 343, 347, 348, 349, 351, 353, 356, 357, 358, 359, 360, 361, 367, 368, 369, 371, 373, 374, 375, 376, 377, 378, 379, 380, 381, 383, 385, 387, 388, 389, 391, 392, 393, 394, 395, 396, 397, 398, 399, 401, 403, 404, 405, 406, 410, 411, 412, 413, 414, 415, 416, 417, 419, 420, 422, 425, 426, 427, 428, 431, 432, 434, 437, 438, 439, 440, 441, 442, 443, 444, or 447 with reference to amino acid positions set forth in SEQ ID NO:3, the modification(s) is/are not the corresponding amino acid replacement(s) set forth in Table 5 or 10 herein, which are amino acid replacements that result in an inactive polypeptide. For example, if the modification is a modification at a position corresponding to position 2 with reference to SEQ ID NO:3, the modification is not replacement to a histidine (H), lysine (K), tryptophan (W) or tyrosine (Y).

Exemplary amino acid replacements at any of the above corresponding positions are set forth in Table 3. Reference to the corresponding amino acid position in Table 3 is with reference to positions set forth in SEQ ID NO:3. It is understood that the replacements can be made in the corresponding position in another PH20 polypeptide by alignment therewith with the sequence set forth in SEQ ID NO:3 (see e.g., FIGS. 1 and 2), whereby the corresponding position is the aligned position. In particular examples, the amino acid replacement(s) can be at the corresponding position in a PH20 polypeptide as set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto, so long as the resulting modified PH20 polypeptide exhibits at least 40% of the hyaluronidase activity of the corresponding PH20 polypeptide not containing the amino acid replacement. In particular, the replacements) can be in a corresponding position in a human PH20 polypeptide, for example, any set forth in any of SEQ ID NOS: 3, 7, 32-66, 69 or 72, or a variant thereof that exhibits at least 90%, 91%, 92%, 93%, 94%, 95%), 96%, 97%, 98%, 99% or more sequence identity to any of SEQ ID NOS: 3, 7, 32-66, 69 or 72. In one example, any one or more of the replacements are in SEQ ID NO:3, so long as the resulting modified PH20 polypeptide exhibits at least 40% of the hyaluronidase activity of the PH20 polypeptide set forth in SEQ ID NO:3.

TABLE 3

Active Mutants

| Corresponding Position | Replacement | Corresponding Position | Replacement | Corresponding Position | Replacement |
|---|---|---|---|---|---|
| 1 | A C E F G H K N P Q R S T V W | 2 | A C G I L P Q S T V | 3 | E H L Y |
| 4 | A I S T V | 5 | H | 6 | A H K L N Q R |
| 7 | M | 8 | I L M P | 9 | K L Q R S V |
| 10 | D E G H N Q R S W | 11 | D G H K S | 12 | A E I K L N R S T |
| 13 | H S T Y | 14 | D I M V | 15 | A M V |

TABLE 3-continued

Active Mutants

| Corresponding Position | Replacement | Corresponding Position | Replacement | Corresponding Position | Replacement |
|---|---|---|---|---|---|
| 20 | S | 22 | H M T Y | 23 | D |
| 24 | A E G H I K L M N R T V Y | 26 | A E G H I K M P Q R S T V W Y | 27 | A D E F H I K L P Q R S T W |
| 28 | A D E F I L M N P R S T V W | 29 | A E G H I K L M P R S T V W | 30 | A F G H K L M P Q R S T V W |
| 31 | A C G H I K L P R S T V W Y | 32 | A C F G H K L M N Q R S T V W Y | 33 | G M P Q R S T W |
| 34 | A E H K Q R W | 35 | F H L Q T V Y | 36 | A D G H K L N R T |
| 37 | F I K M P R W V | 38 | Y | 39 | A L N Q R T Y |
| 40 | L W | 41 | A C D E G H N T V W | 42 | A |
| 43 | N T | 44 | E | 45 | I K |
| 46 | A C E F H L M N R S T V Y | 47 | A D F G H K M Q R S T W Y | 48 | F G H I K M N Q R S V Y |
| 49 | I K R S V | 50 | A C D E H L M Q R S V Y | 51 | A N R S |
| 52 | N P Q R S T | 54 | A F N Q S V | 58 | C G H I K L N P Q R S W Y |
| 59 | Q N | 60 | K | 61 | F I M V |
| 63 | A H I K L M N R S T V W | 65 | R | 66 | H R |
| 67 | F L R V Y | 68 | E G H K L P Q R S T | 69 | A C E F G I L M P R T W Y |
| 70 | A C F G H K L N P R S T V Y | 71 | A D G H L M N Q R S | 72 | A D E H K L M Q R S Y |
| 73 | A C D G H K L M Q R S T W | 74 | A C E F G H K L M N P R S V W | 75 | A C F H L M N Q R S T Y |
| 77 | H K | | | | |
| 79 | L T V | 81 | P | 82 | A E G H I L M N Q R S T V |
| 83 | F G H K L N Q R S T V | 84 | D E F G H I L M N P Q R T W Y | 85 | V |
| 86 | A D E F G H I K L M N P R S T V W | 87 | A C E G H I L M P Q R S T V Y | 89 | C K M P R W |
| 90 | A E G H I K L N Q R S T W | 91 | A Q R | 92 | C H L M T V |
| 93 | D E F G H I L M N P Q R S T V | 94 | A C D E F H L M N Q R S T | 96 | D L V |
| 97 | A C D E F G I L N P Q R S W Y | 98 | A C D E H I L M Q R S V W | 99 | A R S |
| 102 | A C E G H K L M N Q R S T W | | | | |
| 103 | N | 104 | A C G I K M R S T | 105 | A C G H I P Q R S T W V |
| 106 | V | | | | |

TABLE 3-continued

Active Mutants

| Corresponding Position | Replacement | Corresponding Position | Replacement | Corresponding Position | Replacement |
|---|---|---|---|---|---|
| 107 | F I L | 108 | G | 110 | V |
| 114 | A G H M S | 117 | D | 118 | H K L M N Q V |
| 119 | F P Q Y | 120 | D F G H I L N P R S T V W Y | 122 | M |
| 124 | H L R | 125 | A H R S | 127 | A E G H L M N Q R S T V W |
| 128 | A C G I K L Q R S W | 130 | I R | 131 | C E F G H I L M Q R S T V Y |
| 132 | A C E F H I K L N Q S T V Y | 133 | I | 134 | L T V |
| 135 | A C D F G H K L N Q R S W Y | 136 | A C D F H I M N Q R S T W | 137 | A C I T A C H I L M N R S W Y |
| 139 | A C D E F G H K L M R S T V | 140 | A C D F G H I K L M R V W Y | 141 | A D E F G H L M Q R S T V W Y |
| 142 | C D E G H I K L M N P Q R S T | 143 | C E G I K L N V | 144 | R T W |
| 145 | A C D E G H L M N P R | 146 | A C E G H I K N P Q R S T V Y | 147 | A C D F G I L M P Q R S V W Y |
| 148 | C F G H I K L Q R S T V W Y | 149 | C G K L M Q R S T V | 150 | A C D E F G I L N P R S W Y |
| 151 | A C G H K L M N Q R S T V W Y | 152 | A C F I M R T V W Y | 153 | I L S |
| 154 | I R T V | 155 | A C D F G H K L M R S T V W | 156 | A C D G I L M Q R S T V W |
| 157 | W | 158 | A F G H L Q S | 159 | A D E G H L M N Q R S V |
| 160 | C F G H I K L M N Q R S W V Y | 161 | A C D E R S V | 162 | A D E G H L M P Q R S V W Y |
| 163 | A E G K L Q R S T V W | 164 | L M V W | 165 | A C D F N R S V W Y |
| 166 | A C E F G H L N Q R T W Y | 167 | A D G H K M N P R S T Y | 168 | H |
| 169 | L R V | 170 | A Q N R V | 171 | I V |
| 172 | A C | 173 | Q N R | 174 | A G H K M N Q R S T V W Y |
| 175 | E H T V Y | 176 | K L | 177 | V |
| 178 | G K M R | | | | |
| 179 | A C E G I K L M N P R S T V | 180 | F G I K M | 181 | K M Q |
| 182 | L | 183 | E L | 184 | W |
| 186 | Y | | | | |
| 192 | S T | 193 | F G Q R S Y | 195 | A G H I L N Q R S T W V |
| 196 | E G L N R S T W Y | 197 | A D E F G H K L M Q R S T W | 198 | A D E H L N Q R S T W Y |
| 200 | D T | 202 | M | 204 | P W |

TABLE 3-continued

Active Mutants

| Corresponding Position | Replacement | Corresponding Position | Replacement | Corresponding Position | Replacement |
|---|---|---|---|---|---|
| 205 | L R S T V W Y | 206 | H I K L M Q R S T | 208 | A C K L M Q R S T V |
| 209 | A E F G L N R S T | 211 | L W | | |
| 212 | N S T | 213 | A E G H K L M N Q R V W Y | | |
| 214 | Q | 215 | A D E G H K L M Q R T V W Y | 217 | M |
| 218 | F M V | 219 | A C D E H I K L M R S T W | 220 | A D H I L M S T V |
| 221 | A C I M Q T V | 222 | D F G I K L N R S V | 224 | I |
| 226 | W | | | | |
| 230 | I | 231 | T | 232 | S |
| 233 | A F G K L R Y | 234 | L M | 235 | A E G H K T |
| 236 | A G H K R S | 237 | A C E F H L N Q R S T W | 238 | D E H K Q R S T |
| 239 | N | | | | |
| 240 | K A M P Q R S V | 242 | F | 245 | H |
| 247 | I L M | 248 | A H W Y | 251 | L M Y |
| 253 | I | 255 | A G N Q R S | 256 | A H L V |
| 257 | A C G I K L M N Q R T V | 258 | G H N R S | 259 | E G I K L N P Q R S T V W Y |
| 260 | A D E G H L M Q R S Y | 261 | A F K M N Q R T V W | 263 | A H K M R T V |
| 264 | A H | 265 | I | 266 | Y |
| 267 | M T | 269 | A C D S | 270 | M N S T |
| 271 | F G L M S V | 272 | D M R S T | 273 | H T Y |
| 274 | A F S | | | | |
| 275 | L V | 276 | C D E G H I L M R S Y | 277 | A C D E G H K M N Q R S T Y |
| 278 | A E F G H I K N R S T V Y | 279 | A H Q R T | 280 | G Q |
| 282 | D G M Q | 283 | E P R S T | 284 | A E G H L M N Q S T Y |
| 285 | A F G H M N Q Y | 286 | R S W | 287 | I N T |
| 288 | L W | 289 | K S | 290 | I M |
| 291 | C Q R S V | 292 | A C F G H K N P R V W | 293 | A C D F G K L M P Q S V Y |
| 294 | M | | | | |
| 297 | A | 298 | G I | 300 | R |
| 301 | A V | 302 | I W | 303 | D V |
| 304 | G I | 305 | D E N | 306 | D E S |

TABLE 3-continued

Active Mutants

| Corresponding Position | Replacement | Corresponding Position | Replacement | Corresponding Position | Replacement |
|---|---|---|---|---|---|
| 307 | G K N Q S T V W Y | 308 | D G H K N P R T | 309 | D E G H K L M N Q R S T V W |
| 310 | A F G Q R S V Y | 311 | G H K Q S T | 312 | G K L N T |
| 313 | A E G H K L P R S T V Y | 314 | A D H I N Q R S T Y | 315 | A E G H K L M R T Y |
| 316 | D | 317 | A D H I K M N Q R S T W | 318 | D F G H I K M N Q R S T |
| 320 | E G H I K L M N R S W V Y | 321 | A D H K R S T Y | 323 | F I L |
| 324 | A D H M N R S | 325 | A D E G H K M N Q S V W | 326 | C K L V Y |
| 327 | M | 328 | A C G H I K L Q R S T V W Y | 331 | C E V |
| 334 | P T | 335 | S | 338 | Q |
| 339 | M | 342 | A | 343 | T V |
| 347 | A E G L M R S | 348 | D G S | 349 | A E K M N R T |
| 351 | A C I Q S | 353 | T V | 356 | A D H S |
| 357 | A C K S T | 358 | C G L T | 359 | D E H K M T V |
| 360 | T | | | | |
| 361 | H | 367 | A C G K R S | 368 | A E G H K L M R S T V H R S |
| 371 | E F G H I K L M R S V | 373 | A E F K L M R S V | 374 | A H I M N P R S T V W Y |
| 375 | A G I K L M N R S T | 376 | A D E L M Q R S T V Y | 377 | D E H K P R S T |
| 378 | K N R | 379 | G H R S T | 380 | I L P T V W Y |
| 381 | E H K N Q R S V | 383 | A E H I K L M N S T V | 385 | A G H N Q R S T V |
| 387 | S | 388 | F H I M R T V W Y | 389 | A G H K L M P Q R S T Y |
| 391 | C | 392 | A F G K L M Q R S T V W Y | 393 | A D F H K L M N R S T |
| 394 | L W | 395 | A G H K R T W | 396 | A D H L Q R S T |
| 397 | R | 398 | L | | |
| 399 | A C E K M N Q R S T V W | 401 | A E G Q N | 403 | F |
| 404 | A P T | 405 | A F G K M P Q R S W Y | 406 | A C E F G I N Q S T V Y |
| 407 | A D E F G H L M N P Q R V W | 409 | A D E G H I P Q R S T V | 410 | D K M N P Q R S T V Y |
| 411 | A H N P R S T V | 412 | D G H I L N Q P R S V W Y | 413 | A E H K N Q R S T |
| 414 | I K L M | 415 | G S W V Y | 416 | F G H I K L N Q R T V Y |

TABLE 3-continued

Active Mutants

| Corresponding Position | Replacement | Corresponding Position | Replacement | Corresponding Position | Replacement |
|---|---|---|---|---|---|
| 417 | I | 418 | A E F G I L M N P Q R S V Y | 419 | E F G H I K L N R S W Y |
| 420 | I P | 421 | A E G H I K L M N Q R S T Y | 422 | I T |
| 425 | G I K M N R S Y | 426 | E G K N P Q S Y | 427 | H I K Q S T |
| 428 | L M P T | 431 | A E G H I K L N Q R S V W Y | 432 | E G H N S V |
| 433 | A C D E G H I K L P R S T V W | 434 | F G I M V | 435 | A C E G H R S T V Y |
| 436 | C D E G H I K L M Q R S T W Y | 437 | A D G H I K L M Q R S Y | 438 | A C D E G L N P Q R S T V W |
| 439 | A C F G H K L P Q S T V W | 440 | A D E F G H I L M P R S V Y | 441 | A D F G H K L N Q S T V Y |
| 442 | C G H K L P Q R T V W Y | 443 | A E F G H L M N Q R S T W | 444 | D E F G H I K M N R V W Y |
| 445 | A G H L M N P Q R S T V W Y | 446 | A C D E G H I K L M Q R T V W | 447 | D E F G I L M N P Q R T V W |

In particular examples, provided herein is a modified PH20 polypeptide containing an amino acid replacement or replacements at a position or positions corresponding to 1, 6, 8, 9, 10, 11, 12, 14, 15, 20, 22, 24, 26, 27, 28, 29, 30, 31, 32, 33, 34, 35, 36, 37, 38, 39, 40, 41, 46, 47, 48, 49, 50, 52, 58, 59, 63, 67, 68, 69, 70, 71, 72, 73, 74, 75, 79, 82, 83, 84, 86, 87, 89, 90, 92, 93, 94, 97, 102, 104, 107, 114, 118, 120, 127, 128, 130, 131, 132, 135, 138, 139, 140, 141, 142, 143, 144, 146, 147, 148, 149, 150, 151, 152, 155, 156, 158, 160, 162, 163, 164, 165, 166, 167, 169, 170, 172, 173, 174, 175, 178, 179, 193, 195, 196, 198, 204, 205, 206, 209, 212, 213, 215, 219, 220, 221, 222, 232, 233, 234, 235, 236, 237, 238, 240, 247, 248, 249, 257, 258, 259, 260, 261, 263, 267, 269, 271, 272, 273, 274, 276, 277, 278, 279, 282, 283, 285, 287, 289, 291, 292, 293, 298, 305, 307, 308, 309, 310, 313, 314, 315, 317, 318, 320, 321, 324, 325, 326, 328, 335, 347, 349, 351, 353, 356, 359, 367, 368, 369, 371, 373, 374, 375, 376, 377, 380, 381, 383, 385, 389, 392, 393, 395, 396, 399, 401, 404, 405, 406, 407, 409, 410, 412, 416, 418, 419, 421, 425, 427, 428, 431, 433, 436, 437, 438, 439, 440, 441, 442, 443, 444, 445, 446 or 447 with reference to amino acid positions set forth in SEQ ID NO:3. For example, the amino acid positions can be replacements at positions corresponding to replacement of Leucine (L) at position 1 (L1), P6, V8, I9, P10, N11, V12, F14, L15, A20, S22, F24, L26, G27, K28, F29, D30, E31, P32, L33, D34, M35, S36, L37, F38, S39, F40, I41, I46, N47, A48, T49, G50, G52, V58, D59, Y63, I67, D68, S69, I70, T71, G72, V73, T74, V75, I79, K82, I83, S84, G86, D87, L89, D90, A92, K93, K94, T97, V102, N104, M107, E114, T118, A120, D127, V128, K130, N131, R132, E135, Q138, Q139, Q140, N141, V142, Q143, L144, L146, T147, E148, A149, T150, E151, K152, Q155, E156, E158, A160, K162, D163, F164, L165, V166, E167, I169, K170, G172, K173, L174, L175, N178, H179, H193, K195, K196, G198, F204, N205, V206, K209, D212, D213, S215, N219, E220, S221, T222, T232, Q233, Q234, S235, P236, V237, A238, T240, V247, R248, E249, P257, D258, A259, K260, S261, L263, A267, T269, I271, V272, F273, T274, Q276, V277, L278, K279, S282, Q283, E285, V287, T289, G291, E292, T293, A298, G305, L307, S308, I309, M310, M313, K314, S315, L317, L318, D320, N321, E324, T325, I326, N328, T335, Q347, Q349, V351, I353, N356, S359, P367, D368, N369, A371, Q373, L374, E375, K376, G377, F380, T381, R383, K385, E389, E392, Q393, S395, E396, Y399, S401, S404, T405, L406, S407, K409, E410, A412, D416, D418, A419, D421, A425, G427, A428, D431, F433, P436, P437, M438, E439, T440, E441, E442, P443, Q444, I445, F446 or Y447 with reference to amino acid positions set forth in SEQ ID NO:3.

Exemplary amino acid replacements in the modified PH20 polypeptides provided herein include, but are not limited, replacement with: histidine (H) at a position corresponding to position 1; A at a position corresponding to position 1; E at a position corresponding to position 1; G at a position corresponding to position 1; K at a position corresponding to position 1; Q at a position corresponding to position 1; R at a position corresponding to position 1; A at a position corresponding to position 6; M at a position corresponding to position 8; Q at a position corresponding to position 9; G at a position corresponding to position 10; H at a position corresponding to position 10; S at a position corresponding to position 11; E at a position corresponding to position 12; I at a position corresponding to position 12; K at a position corresponding to position 12; T at a position corresponding to position 12; V at a position corresponding to position 14; V at a position corresponding to position 15; M at a position corresponding to position 15; S at a position corresponding to position 20; T at a position corresponding to position 22; E at a position corresponding to position 24; H at a position corresponding to position 24; R at a position corresponding to position 26; E at a position corresponding to position 26;

K at a position corresponding to position 26; M at a position corresponding to position 26; Q at a position corresponding to position 26; R at a position corresponding to position 26; D at a position corresponding to position 27; K at a position corresponding to position 27; R at a position corresponding to position 27; R at a position corresponding to position 28; E at a position corresponding to position 29; I at a position corresponding to position 29; K at a position corresponding to position 29; L at a position corresponding to position 29; M at a position corresponding to position 29; P at a position corresponding to position 29; R at a position corresponding to position 29; S at a position corresponding to position 29; T at a position corresponding to position 29; V at a position corresponding to position 29; G at a position corresponding to position 30; H at a position corresponding to position 30; K at a position corresponding to position 30; L at a position corresponding to position 30; M at a position corresponding to position 30; R at a position corresponding to position 30; S at a position corresponding to position 30; A at a position corresponding to position 31; C at a position corresponding to position 31; G at a position corresponding to position 31; H at a position corresponding to position 31; I at a position corresponding to position 31; K at a position corresponding to position 31; L at a position corresponding to position 31; P at a position corresponding to position 31; R at a position corresponding to position 31; S at a position corresponding to position 31; T at a position corresponding to position 31; V at a position corresponding to position 31; W at a position corresponding to position 31; C at a position corresponding to position 32; F at a position corresponding to position 32; G at a position corresponding to position 32; H at a position corresponding to position 32; W at a position corresponding to position 33; G at a position corresponding to position 33; W at a position corresponding to position 34; Q at a position corresponding to position 35; V at a position corresponding to position 35; H at a position corresponding to position 36; N at a position corresponding to position 36; F at a position corresponding to position 37; M at a position corresponding to position 37; Y at a position corresponding to position 38; A at a position corresponding to position 39; L at a position corresponding to position 39; N at a position corresponding to position 39; T at a position corresponding to position 39; L at a position corresponding to position 40; T at a position corresponding to position 41; L at a position corresponding to position 46; R at a position corresponding to position 46; D at a position corresponding to position 47; F at a position corresponding to position 47; T at a position corresponding to position 47; W at a position corresponding to position 47, with F at a position corresponding to position 48; H at a position corresponding to position 48; K at a position corresponding to position 48; N at a position corresponding to position 48; R at a position corresponding to position 49; D at a position corresponding to position 50; S at a position corresponding to position 50; M at a position corresponding to position 50; N at a position corresponding to position 52; Q at a position corresponding to position 52; R at a position corresponding to position 52; S at a position corresponding to position 52; T at a position corresponding to position 52; C at a position corresponding to position 58; K at a position corresponding to position 58; L at a position corresponding to position 58; P at a position corresponding to position 58; Q at a position corresponding to position 58; R at a position corresponding to position 58; H at a position corresponding to position 58; N at a position corresponding to position 58; Y at a position corresponding to position 58; N at a position corresponding to position 59; K at a position corresponding to position 63; L at a position corresponding to position 63; M at a position corresponding to position 63; R at a position corresponding to position 63; W at a position corresponding to position 63; V at a position corresponding to position 67; H at a position corresponding to position 68; P at a position corresponding to position 68; Q at a position corresponding to position 68; A at a position corresponding to position 69; C at a position corresponding to position 69; E at a position corresponding to position 69; F at a position corresponding to position 69; G at a position corresponding to position 69; I at a position corresponding to position 69; L at a position corresponding to position 69; M at a position corresponding to position 69; P at a position corresponding to position 69; R at a position corresponding to position 69; T at a position corresponding to position 69; W at a position corresponding to position 69; Y at a position corresponding to position 69; A at a position corresponding to position 70; C at a position corresponding to position 70; F at a position corresponding to position 70; G at a position corresponding to position 70; H at a position corresponding to position 70; K at a position corresponding to position 70; L at a position corresponding to position 70; N at a position corresponding to position 70; P at a position corresponding to position 70; R at a position corresponding to position 70; S at a position corresponding to position 70; T at a position corresponding to position 70; V at a position corresponding to position 70; Y at a position corresponding to position 70; G at a position corresponding to position 71; N at a position corresponding to position 71; R at a position corresponding to position 71; S at a position corresponding to position 71; K at a position corresponding to position 72; M at a position corresponding to position 72; Q at a position corresponding to position 72; A at a position corresponding to position 73; H at a position corresponding to position 73; K at a position corresponding to position 73; L at a position corresponding to position 73; Q at a position corresponding to position 73; R at a position corresponding to position 73; T at a position corresponding to position 73; W at a position corresponding to position 73; A at a position corresponding to position 74; C at a position corresponding to position 74; E at a position corresponding to position 74; F at a position corresponding to position 74; G at a position corresponding to position 74; H at a position corresponding to position 74; K at a position corresponding to position 74; L at a position corresponding to position 74; M at a position corresponding to position 74; N at a position corresponding to position 74; P at a position corresponding to position 74; R at a position corresponding to position 74; S at a position corresponding to position 74; V at a position corresponding to position 74; W at a position corresponding to position 74; F at a position corresponding to position 75; L at a position corresponding to position 75; M at position corresponding to position 75; R at a position corresponding to position 75; T at a position corresponding to position 75; L at a position corresponding to position 79; L at a position corresponding to position 82; N at a position corresponding to position 82; V at a position corresponding to position 83; Q at a position corresponding to position 83; S at a position corresponding to position 83; G at a position corresponding to position 83; E at a position corresponding to position 84; F at a position corresponding to position 84; G at a position corresponding to position 84; N at a position corresponding to position 84; R at a position corresponding to position 84; A at a position corresponding to position 86; H at a position corresponding to position 86; K at a position corresponding to position 86; N at a position corresponding to position 86; S at a position corresponding to position 86; T at a position corresponding to position 86; W at a position corresponding to position 86; C at a position corresponding to position 87; G at a position corresponding to position 87; L at a position corresponding to position 87; M at a position corresponding to position 87; R at a position corresponding to position 87; S at a position corresponding to position 87; T at a position corresponding to position 87; V at a position corresponding to position 87; Y at a position corresponding to position 87; C at a position corresponding to position 89; A at a position corresponding to position 90; E at a position corresponding to position 90; H at a position corresponding to position 90; K at a position corresponding to position 90; N at a position corresponding to position 90; R at a position corresponding to position 90; C at a position corresponding to position 92; L at a position corresponding to position 92; I at a position corresponding to position 93; L at a position corresponding to position 93; Q at a position corresponding to position 93; R at a position corresponding to position 93; S at a position corresponding to position 93; T at a position corresponding to position 93; D at a position corresponding to position 94; Q at a position corresponding to position 94; R at a position corresponding to position 94; A at a position corresponding to position 97; C at an amino acid residue corresponding to position 97; D at a position corresponding to position 97; E at a position corresponding to position 97; G at a position corresponding to position 97; L at a position corresponding to position 97; S at a position corresponding to position 97; S at a position corresponding to position 102; T at a position corresponding to position 102; R at a position corresponding to position 104; L at a position corresponding to position 107; A at a position corresponding to position 114; Q at a position corresponding to position 118; H at a position corresponding to position 120; F at a position corresponding to position 120; I at a position corresponding to position 120; S at a position corresponding to position 120; V at a position corresponding to position 120; Y at a position corresponding to position 120; E at a position corresponding to position 127; H at a position corresponding to position 127; N at a position corresponding to position 127; Q at a position corresponding to position 127; R at a position corresponding to position 127; I at a position corresponding to position 128; R at a position corresponding to position 130; G at a position corresponding to position 131; I at a position corresponding to position 131; M at a position corresponding to position 131; Q at a position corresponding to position 131; R at a position corresponding to position 131; V at a position corresponding to position 131; N at a position corresponding to position 132; L at a position corresponding to position 132; D at a position corresponding to position 135; G at a position corresponding to position 135; R at a position corresponding to position 135, with L at a position corresponding to position 138; T at a position corresponding to position 139; K at a position corresponding to position 140; H at a position corresponding to position 141; R at a position corresponding to position 141; S at a position corresponding to position 141; W at a position corresponding to position 141; Y at a position corresponding to position 141; D at a position corresponding to position 142; G at a position corresponding to position 142; K at a position corresponding to position 142; N at a position corresponding to position 142; P at a position corresponding to position 142; Q at a position corresponding to position 142; R at a position corresponding to position 142; S at a position corresponding to position 142; T at a position corresponding to position 142; G at a position corresponding to position 143; K at a position corresponding to position 143; R at a position corresponding to position 144; T at a position corresponding to position 144; P at a position corresponding to position 146; R at a position corresponding to position 146; A at a position corresponding to position 147; F at a position corresponding to position 147; L at a position corresponding to position 147; R at a position corresponding to position 147; S at a position corresponding to position 147; V at a position corresponding to position 147; H at a position corresponding to position 148; K at a position corresponding to position 148; Q at a position corresponding to position 148; T at a position corresponding to position 149; V at a position corresponding to position 149; A at a position corresponding to position 150; D at a position corresponding to position 150; G at a position corresponding to position 150; N at a position corresponding to position 150; S at a position corresponding to position 150; W at a position corresponding to position 150; Y at a position corresponding to position 150; A at a position corresponding to position 151; H at a position corresponding to position 151; K at a position corresponding to position 151; L at a position corresponding to position 151; M at a position corresponding to position 151; Q at a position corresponding to position 151; R at a position corresponding to position 151; S at a position corresponding to position 151; T at a position corresponding to position 151; V at a position corresponding to position 151; W at a position corresponding to position 151; Y at a position corresponding to position 151; R at a position corresponding to position 152; T at a position corresponding to position 152; W at a position corresponding to position 152; D at a position corresponding to position 155; G at a position corresponding to position 155; K at a position corresponding to position 155; R at a position corresponding to position 155; D at a position corresponding to position 156; Q at a position corresponding to position 158; S at a position corresponding to position 158; S at a position corresponding to position 160; E at a position corresponding to position 162; A at a position corresponding to position 163; E at a position corresponding to position 163; K at a position corresponding to position 163; Q at a position corresponding to position 163; R at a position corresponding to position 163; S at a position corresponding to position 163; M at a position corresponding to position 164; V at a position corresponding to position 164; D at a position corresponding to position 165; F at a position corresponding to position 165; N at a position corresponding to position 165; S at a position corresponding to position 165; V at a position corresponding to position 165; A at a position corresponding to position 166; E at a position corresponding to position 166; F at a position corresponding to position 166; H at a position corresponding to position 166; L at a position corresponding to position 166; Q at a position corresponding to position 166; R at a position corresponding to position 166; T at a position corresponding to position 166; W at a position corresponding to position 166; Y at a position corresponding to position 166; D at a position corresponding to position 167; L at a position corresponding to position 169; R at a position corresponding to position 170; A at a position corresponding to position 172; R at a position corresponding to position 173; G at a position corresponding to position 174; K at a position corresponding to position 174; N at a position corresponding to position 174; R at a position corresponding to position 174; T at a position corresponding to position 174; T at a position corresponding to position 175; K at a position corresponding to position 178; R at a position corresponding to position 178; K at a position corresponding to position 179; Q at a position corresponding to position 193; T at a position corresponding to position 195; N at a position corresponding to position 195; with E at a position corresponding to position 196; R at a position corresponding to position 196; with D at a position corresponding to position 198; P at a position corresponding to position 204; A at a position corresponding to position 205; E at a position corresponding to position 205; L at a position corresponding to position 205; T at a position corresponding to position 205; I at a position corresponding to position 206; K at a position corresponding to position 206; L at a position corresponding to position 206; R at a position corresponding to position 206; R at a position corresponding to position 209; N at a position corresponding to position 212; S at a position corresponding to position 212; A at a position corresponding to position 213; M at a position corresponding to position 213; N at a position corresponding to position 213; H at a position corresponding to position 215; M at a position corresponding to position 215; A at a position corresponding to position 219; I at a position corresponding to position 219; K at a position corresponding to position 219; S at a position corresponding to position 219; H at a position corresponding to position 220; I at a position corresponding to position 220; L at a position corresponding to position 220; V at a position corresponding to position 220; Q at a position corresponding to position 221; G at a position corresponding to position 222; F at a position corresponding to position 232; G at a position corresponding to position 233; K at a position corresponding to position 233; R at a position corresponding to position 233; M at a position corresponding to position 234; A at a position corresponding to position 235; R at a position corresponding to position 236; C at a position corresponding to position 237; E at a position corresponding to position 237; H at a position corresponding to position 237; Q at a position corresponding to position 237; T at a position corresponding to position 237; E at a position corresponding to position 238; H at a position corresponding to amino acid position 238; S at a position corresponding to position 238; A at a position corresponding to position 240; Q at a position corresponding to position 240; I at a position corresponding to position 247; A at a position corresponding to position 248; V at a position corresponding to position 249; G at a position corresponding to position 257; T at a position corresponding to position 257; R at a position corresponding to position 257; N at a position corresponding to position 258; S at a position corresponding to position 258; P at a position corresponding to position 259; M at a position corresponding to position 260; Y at a position corresponding to position 260; A at a position corresponding to position 261; K at a position corresponding to position 261; N at a position corresponding to position 261; K at a position corresponding to position 263; R at a position corresponding to position 263; T at a position corresponding to position 267; A at a position corresponding to position 269; L at a position corresponding to position 271; M at a position corresponding to position 271; D at a position corresponding to position 272; T at a position corresponding to position 272; H at a position corresponding to position 273; Y at a position corresponding to position 273; F at a position corresponding to position 274; D at a position corresponding to position 276; H at a position corresponding to position 276; M at a position corresponding to position 276; R at a position corresponding to position 276; S at a position corresponding to position 276; Y at a position corresponding to position 276; A at a position corresponding to position 277; E at a position corresponding to position 277; H at a position corresponding to position 277; K at a position corresponding to position 277; M at a position corresponding to position 277; N at a position corresponding to position 277; Q at a position corresponding to position 277; R at a position corresponding to position 277; S at a position corresponding to position 277; T at a position corresponding to position 277; E at a position corresponding to position 278; F at a position corresponding to position 278; G at a position corresponding to position 278; H at a position corresponding to position 278; K at a position corresponding to position 278; N at a position corresponding to position 278; R at a position corresponding to position 278; S at a position corresponding to position 278; T at a position corresponding to position 278; Y at a position corresponding to position 278; H at a position corresponding to position 279; M at a position corresponding to position 282; S at a position corresponding to position 283; H at a position corresponding to position 285; T at a position corresponding to position 287; S at a position corresponding to position 289; S at a position corresponding to position 291; V at a position corresponding to position 291; C at a position corresponding to position 292; F at a position corresponding to position 292; H at a position corresponding to position 292; K at a position corresponding to position 292; R at a position corresponding to position 292; V at a position corresponding to position 292; A at a position corresponding to position 293; C at a position corresponding to position 293; D at a position corresponding to position 293; F at a position corresponding to position 293; K at a position corresponding to position 293; M at a position corresponding to position 293; P at a position corresponding to position 293; Q at a position corresponding to position 293; V at a position corresponding to position 293; Y at a position corresponding to position 293; G at a position corresponding to position 298; E at a position corresponding to position 305; G at a position corresponding to position 307; D at a position corresponding to position 308; G at a position corresponding to position 308; K at a position corresponding to position 308; N at a position corresponding to position 308; R at a position corresponding to position 308; E at a position corresponding to position 309; G at a position corresponding to position 309; H at a position corresponding to position 309; L at a position corresponding to position 309; M at a position corresponding to position 309; N at a position corresponding to position 309; Q at a position corresponding to position 309; R at a position corresponding to position 309; S at a position corresponding to position 309; T at a position corresponding to position 309; V at a position corresponding to position 309; A at a position corresponding to position 310; G at a position corresponding to position 310; Q at a position corresponding to position 310; S at a position corresponding to position 310; A at a position corresponding to position 313; G at a position corresponding to position 313; H at a position corresponding to position 313; K at a position corresponding to position 313; P at a position corresponding to position 313; R at a position corresponding to position 313; T at a position corresponding to position 313; Y at a position corresponding to position 313; with S at a position corresponding to position 314; Y at a position corresponding to position 314; A at a position corresponding to position 315; H at a position corresponding to position 315; Y at a position corresponding to position 315; A at a position corresponding to position 317; I at a position corresponding to position 317; K at a position corresponding to position 317; N at a position corresponding to position 317; Q at a position corresponding to position 317; R at a position corresponding to position 317; S at a position corresponding to position 317; T at a position corresponding to position 317; W at a position corresponding to position 317; D at a position corresponding to position 318; H at a position corresponding to position 318; K at a position corresponding to position 318; M at a position corresponding to position 318; R at a position corresponding to position 318; H at a position corresponding to position 320; K at a position corresponding to position 320; R at a position corresponding to position 320; R at a position corresponding to position 321; S at a position corresponding to position 321; N at a position corresponding to position 324; R at a position corresponding to position 324; A at a position corresponding to position 325; D at a position corresponding to position 325; E at a position corresponding to position 325; G at a position corresponding to position 325; H at a position corresponding to position 325; K at a position corresponding to position 325; M at a position corresponding to position 325; N at a position corresponding to position 325; Q at a position corresponding to position 325; S at a position corresponding to position 325; V at a position corresponding to position 325; L at a position corresponding to position 326; V at a position corresponding to position 326; C at a position corresponding to position 328; G at a position corresponding to position 328; I at a position corresponding to position 328; K at a position corresponding to position 328; L at a position corresponding to position 328; S at a position corresponding to position 328; Y at a position corresponding to position 328; S at a position corresponding to position 335; A at a position corresponding to position 347; G at a position corresponding to position 347; S at a position corresponding to position 347; M at a position corresponding to position 349; R at a position corresponding to position 349; S at a position corresponding to position 351; V at a position corresponding to position 353; with H at a position corresponding to position 356; S at a position corresponding to position 356; E at a position corresponding to position 359; H at a position corresponding to position 359; T at a position corresponding to position 359; A at a position corresponding to position 367; G at a position corresponding to position 367; K at a position corresponding to position 367; S at a position corresponding to position 367; A at a position corresponding to position 368; E at a position corresponding to position 368; K at a position corresponding to position 368; L at a position corresponding to amino acid position 368; M at a position corresponding to amino acid position 368; R at a position corresponding to position 368; T at a position corresponding to amino acid position 368; H at a position corresponding to position 369; R at a position corresponding to position 369; F at a position corresponding to position 371; H at a position corresponding to position 371; K at a position corresponding to position 371; L at a position corresponding to position 371; R at a position corresponding to position 371; S at a position corresponding to position 371; M at a position corresponding to position 373; H at a position corresponding to position 374; P at a position corresponding to position 374; A at a position corresponding to position 375; G at a position corresponding to position 375; K at a position corresponding to position 375; R at a position corresponding to position 375; D at a position corresponding to position 376; E at a position corresponding to position 376; Q at a position corresponding to position 376; R at a position corresponding to position 376; T at a position corresponding to position 376; V at a position corresponding to position 376; Y at a position corresponding to position 376; D at a position corresponding to position 377; E at a position corresponding to position 377; H at a position corresponding to position 377; K at a position corresponding to position 377; P at a position corresponding to position 377; R at a position corresponding to position 377; S at a position corresponding to position 377; T at a position corresponding to position 377; W at a position corresponding to position 380; Y at a position corresponding to position 380; S at a position corresponding to position 381; I at a position corresponding to position 383; K at a position corresponding to position 383; L at a position corresponding to position 383; S at a position corresponding to position 383; A at a position corresponding to position 385; Q at a position corresponding to position 385; V at a position corresponding to position 385; A at a position corresponding to position 389; G at a position corresponding to position 389; L at a position corresponding to position 389; K at a position corresponding to position 389; Q at a position corresponding to position 389; S at a position corresponding to position 389; A at a position corresponding to position 392; F at a position corresponding to position 392; M at a position corresponding to position 392; Q at a position corresponding to position 392; R at a position corresponding to position 392; V at a position corresponding to position 392; F at a position corresponding to position 393; M at a position corresponding to position 393; A at a position corresponding to position 395; H at a position corresponding to position 395; R at a position corresponding to position 395; A at a position corresponding to position 396; H at a position corresponding to position 396; Q at a position corresponding to position 396; S at a position corresponding to position 396; K at a position corresponding to position 399; M at a position corresponding to position 399; T at a position corresponding to position 399; V at a position corresponding to position 399; W at a position corresponding to position 399; A at a position corresponding to position 401; E at a position corresponding to position 401; A at a position corresponding to position 404; G at a position corresponding to position 405; F at a position corresponding to position 406; N at a position corresponding to position 406; A at a position corresponding to position 407; D at a position corresponding to position 407; E at a position corresponding to position 407; F at a position corresponding to position 407; H at a position corresponding to position 407; Q at a position corresponding to position 407; P at a position corresponding to position 407; A at a position corresponding to position 409; Q at a position corresponding to position 409; T at a position corresponding to position 410; Q at a position corresponding to position 412; R at a position corresponding to position 412; V at a position corresponding to position 412; L at a position corresponding to position 416; E at a position corresponding to position 418; L at a position corresponding to position 418; P at a position corresponding to position 418; R at a position corresponding to position 418; V at a position corresponding to position 418; F at a position corresponding to position 419; H at a position corresponding to position 419; I at a position corresponding to position 419; K at a position corresponding to position 419; R at a position corresponding to position 419; S at a position corresponding to position 419; Y at a position corresponding to position 419; A at a position corresponding to position 421; H at a position corresponding to position 421; K at a position corresponding to position 421; N at a position corresponding to position 421; Q at a position corresponding to position 421; R at a position corresponding to position 421; S at a position corresponding to position 421; G at a position corresponding to position 425; K at a position corresponding to position 425; Q at a position corresponding to position 427; T at a position corresponding to position 427; L at a position corresponding to position 428; A at a position corresponding to position 431; G at a position corresponding to position 431; E at a position corresponding to position 431; H at a position corresponding to position 431; K at a position corresponding to position 431; L at a position corresponding to position 431; N at a position corresponding to position 431; Q at a position corresponding to position 431; R at a position corresponding to position 431; S at a position corresponding to position 431; V at a position corresponding to position 431; A at a position corresponding to position 433; H at a position corresponding to position 433; I at a position corresponding to position 433; K at a position corresponding to position 433; L at a position corresponding to position 433; R at a position corresponding to position 433; T at a position corresponding to position 433; V at a position corresponding to position 433; W at a position corresponding to position 433; K at a position corresponding to position 436; I at a position corresponding to position 437; M at a position corresponding to position 437; A at a position corresponding to position 438; D at a position corresponding to position 438; E at a position corresponding to position 438; L at a position corresponding to position 438; N at a position corresponding to position 438; T at a position corresponding to position 438; A at a position corresponding to position 439; C at a position corresponding to position 439; K at a position corresponding to position 439; P at a position corresponding to position 439; Q at a position corresponding to position 439; T at a position corresponding to position 439; V at a position corresponding to position 439; D at a position corresponding to position 440; H at a position corresponding to position 440; M at a position corresponding to position 440; P at a position corresponding to position 440; R at a position corresponding to position 440; S at a position corresponding to position 440; A at a position corresponding to position 441; F at a position corresponding to position 441; C at a position corresponding to position 442; G at a position corresponding to position 442; R at a position corresponding to position 442; A at a position corresponding to position 443; E at a position corresponding to position 443; F at a position corresponding to position 443; G at a position corresponding to position 443; M at a position corresponding to position 443; N at a position corresponding to position 443; E at a position corresponding to position 444; H at a position corresponding to position 444; V at a position corresponding to position 444; H at a position corresponding to position 445; M at a position corresponding to position 445; N at a position corresponding to position 445; P at a position corresponding to position 445; Q at a position corresponding to position 445; S at a position corresponding to position 445; T at a position corresponding to position 445; V at a position corresponding to position 445; W at a position corresponding to position 445; A at a position corresponding to position 446; M at a position corresponding to position 446; W at a position corresponding to position 446; D at a position corresponding to position 447; E at a position corresponding to position 447; G at a position corresponding to position 447; I at a position corresponding to position 447; N at a position corresponding to position 447; P at a position corresponding to position 447; Q at a position corresponding to position 447; T at a position corresponding to position 447, and/or replacement with V at a position corresponding to position 447, each with reference to amino acid positions set forth in SEQ ID NO:3.

Exemplary of such modified PH20 polypeptides are any having the sequence of amino acids set forth in any of SEQ ID NOS: 74-855, or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS:74-855 and contains the amino acid replacement and exhibits hyaluronidase activity.

Any of the above modified PH20 polypeptides provided herein can exhibit altered, such as improved or increased, properties or activities compared to the corresponding PH20 polypeptide not containing the amino acid modification (e.g., amino acid replacement). For example, the altered activities or properties can be an increased catalytic activity and/or an increased stability under denaturing conditions.

a. Increased Activity

Provided herein are modified or variant PH20 polypeptides that contain one or more amino acid replacements in a PH20 polypeptide and that exhibit increased hyaluronidase activity compared to the corresponding PH20 polypeptide not containing the amino acid replacement(s), for example, the PH20 polypeptide set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto. In particular, the modified or variant PH20 polypeptides provided herein exhibit increased hyaluronidase activity compared to the corresponding PH20 polypeptide not containing the amino acid replacement, for example, the PH20 polypeptide set forth in any of SEQ ID NOS: 3, 7, 32-66, 69 or 72 and in particular the PH20 polypeptide set forth in SEQ ID NO:3.

The modified PH20 polypeptide can exhibit hyaluronidase activity that is at least or about at least or 120%, 130%, 135%, 140%, 145%, 150%, 160%, 170%, 180%, 200%, 250%, 300%, 350%, 400%, 500%, 1500%, 2000%, 3000%, 4000%, 5000% of the hyaluronidase activity of the corresponding PH20 polypeptide not containing the amino acid replacement(s), for example the PH20 polypeptide set forth in any of any of SEQ ID NOS: 2, 3, 6-66, 68-72, 856-861, 869 or 870 or a variant thereof, under the same conditions. For example, the hyaluronidase activity is increased at least or about at least 1.2-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, 60-fold, 70-fold, 80-fold, 90-fold, 100-fold, 200-fold, 300-fold, 400-fold or more.

In particular examples, the modified PH20 polypeptides contain an amino acid replacement at one or more amino acid positions identified as being associated with increased hyaluronidase activity. As described herein, such positions have been identified using mutagenesis and selection or screening methods to identify those positions that result in increased hyaluronidase activity. The PH20 polypeptide also can contain other modifications, such as other amino acid replacements, that alone are not associated with increased activity so long as the resulting modified PH20 polypeptide exhibits increased hyaluronidase activity compared to the PH20 not containing the amino acid modification(s), such as amino acid replacement(s). The modified PH20 polypeptide provided herein can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, or more amino acid replacements. Additional modifications, such as insertions or deletions, also can be included. The amino acid replacement can be in a PH20 polypeptide as set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto. For example, the replacement(s) can be in a human PH20 polypeptide, for example, any set forth in any of SEQ ID NOS: 3, 7, 32-66, 69 or 72 or a variant thereof.

For example, the modified PH20 polypeptides provided herein contain an amino acid replacement (substitution) at one or more amino acid positions corresponding to positions 1, 12, 15, 24, 26, 27, 29, 30, 31, 32, 33, 37, 39, 46, 48, 52, 58, 63, 67, 68, 69, 70, 71, 72, 73, 74, 75, 84, 86, 87, 92, 93, 94, 97, 118, 120, 127, 131, 135, 141, 142, 147, 148, 150, 151, 152, 155, 156, 163, 164, 165, 166, 169, 170, 174, 198, 206, 209, 212, 213, 215, 219, 233, 234, 236, 238, 247, 257, 259, 260, 261, 263, 269, 271, 272, 276, 277, 278, 282, 291, 293, 305, 308, 309, 310, 313, 315, 317, 318, 320, 324, 325, 326, 328, 347, 353, 359, 371, 377, 380, 389, 392, 395, 399, 405, 407, 409, 410, 418, 419, 421, 425, 431, 433, 436, 437, 438, 439, 440, 441, 442, 443, 445, 446 or 447 with reference to amino acid positions set forth in SEQ ID NO:3. For example, the amino acid positions can be replacements at positions corresponding to replacement of Leucine (L) at position 1 (L1), V12, L15, F24, L26, G27, F29, D30, E31, P32, L33, L37, S39, I46, A48, G52, V58, Y63, I67, D68, S69, I70, T71, G72, V73, T74, V75, S84, G86, D87, A92, K93, K94, T97, T118, A120, D127, N131, E135, N141, V142, T147, E148, T150, E151, K152, Q155, E156, D163, F164, L165, V166, I169, K170, L174, G198, V206, K209, D212, D213, S215, N219, Q233, Q234, P236, A238, V247, P257, A259, K260, S261, L263, T269, I271, V272, Q276, V277, L278, S282, G291, T293, G305, S308, I309, M310, M313, S315, L317, L318, D320, E324, T325, I326, N328, Q347, I353, S359, A371, G377, F380, E389, E392, S395, Y399, T405, S407, K409, E410, D418, A419, D421, A425, D431, F433, P436, P437, M438, E439, T440, E441, E442, P443, I445, F446 or Y447 with reference to amino acid positions set forth in SEQ ID NO:3. Exemplary of such modified PH20 polypeptides are polypeptides that exhibit at least 1.5-fold or more the activity of the corresponding PH20 polypeptide not containing the amino acid replacement.

Exemplary of amino acid replacements in the modified PH20 polypeptides provided herein include, but are not limited, replacement: with histidine (H) at a position corresponding to position 1; Q at a position corresponding to position 1; E at a position corresponding to position 12; T at a position corresponding to position 12; V at a position corresponding to position 15; E at a position corresponding to position 24; H at a position corresponding to position 24; E at a position corresponding to position 26; K at a position corresponding to position 26; K at a position corresponding to position 27; R at a position corresponding to position 27; E at a position corresponding to position 29; I at a position corresponding to position 29; L at a position corresponding to position 29; M at a position corresponding to position 29; P at a position corresponding to position 29; S at a position corresponding to position 29; V at a position corresponding to position 29; G at a position corresponding to position 30; H at a position corresponding to position 30; K at a position corresponding to position 30; M at a position corresponding to position 30; R at a position corresponding to position 30; S at a position corresponding to position 30; A at a position corresponding to position 31; C at a position corresponding to position 31; H at a position corresponding to position 31; I at a position corresponding to position 31; K at a position corresponding to position 31; L at a position corresponding to position 31; P at a position corresponding to position 31; R at a position corresponding to position 31; S at a position corresponding to position 31; T at a position corresponding to position 31; V at a position corresponding to position 31; F at a position corresponding to position 32; G at a position corresponding to position 32; H at a position corresponding to position 32; W at a position corresponding to position 33; F at a position corresponding to position 37; N at a position corresponding to position 39; T at a position corresponding to position 39; R at a position corresponding to position 46; F at a position corresponding to position 48; H at a position corresponding to position 48; N at a position corresponding to position 48; Q at a position corresponding to position 52; K at a position corresponding to position 58; Q at a position corresponding to position 58; W at a position corresponding to position 63; V at a position corresponding to position 67; H at a position corresponding to position 68; Q at a position corresponding to position 68; A at a position corresponding to position 69; C at a position corresponding to position 69; F at a position corresponding to position 69; G at a position corresponding to position 69; I at a position corresponding to position 69; L at a position corresponding to position 69; M at a position corresponding to position 69; P at a position corresponding to position 69; R at a position corresponding to position 69; W at a position corresponding to position 69; Y at a position corresponding to position 69; A at a position corresponding to position 70; C at a position corresponding to position 70; F at a position corresponding to position 70; G at a position corresponding to position 70; H at a position corresponding to position 70; K at a position corresponding to position 70; L at a position corresponding to position 70; N at a position corresponding to position 70; P at a position corresponding to position 70; R at a position corresponding to position 70; S at a position corresponding to position 70; T at a position corresponding to position 70; V at a position corresponding to position 70; R at a position corresponding to position 71; S at a position corresponding to position 71; M at a position corresponding to position 72; Q at a position corresponding to position 72; H at a position corresponding to position 73; L at a position corresponding to position 73; W at a position corresponding to position 73; A at a position corresponding to position 74; C at a position corresponding to position 74; G at a position corresponding to position 74; N at a position corresponding to position 74; P at a position corresponding to position 74; R at a position corresponding to position 74; S at a position corresponding to position 74; V at a position corresponding to position 74; W at a position corresponding to position 74; F at a position corresponding to position 75; L at a position corresponding to position 75; R at a position corresponding to position 75; T at a position corresponding to position 75; G at a position corresponding to position 84; R at a position corresponding to position 84; A at a position corresponding to position 86; C at a position corresponding to position 87; T at a position corresponding to position 87; Y at a position corresponding to position 87; C at a position corresponding to position 92; I at a position corresponding to position 93; L at a position corresponding to position 93; R at a position corresponding to position 93; T at a position corresponding to position 93; R at a position corresponding to position 94; G at a position corresponding to position 97; Q at a position corresponding to position 118; F at a position corresponding to position 120; V at a position corresponding to position 120; Y at a position corresponding to position 120; H at a position corresponding to position 127; N at a position corresponding to position 127; G at a position corresponding to position 131; R at a position corresponding to position 131; V at a position corresponding to position 131; D at a position corresponding to position 135; G at a position corresponding to position 135; R at a position corresponding to position 135, with H at a position corresponding to position 141; Y at a position corresponding to position 141; R at a position corresponding to position 142; R at a position corresponding to position 147; V at a position corresponding to position 147; K at a position corresponding to position 148; G at a position corresponding to position 150; K at a position corresponding to position 151; L at a position corresponding to position 151; M at a position corresponding to position 151; Q at a position corresponding to position 151; R at a position corresponding to position 151; R at a position corresponding to position 152; G at a position corresponding to position 155; K at a position corresponding to position 155; D at a position corresponding to position 156; A at a position corresponding to position 163; E at a position corresponding to position 163; K at a position corresponding to position 163; R at a position corresponding to position 163; M at a position corresponding to position 164; D at a position corresponding to position 165; N at a position corresponding to position 165; A at a position corresponding to position 166; F at a position corresponding to position 166; H at a position corresponding to position 166; L at a position corresponding to position 166; Q at a position corresponding to position 166; R at a position corresponding to position 166; T at a position corresponding to position 166; Y at a position corresponding to position 166; L at a position corresponding to position 169; R at a position corresponding to position 170; K at a position corresponding to position 174; D at a position corresponding to position 198; K at a position corresponding to position 206; L at a position corresponding to position 206; N at a position corresponding to position 212; M at a position corresponding to position 213; N at a position corresponding to position 213; M at a position corresponding to position 215; S at a position corresponding to position 219; K at a position corresponding to position 233; R at a position corresponding to position 233; M at a position corresponding to position 234; R at a position corresponding to position 236; E at a position corresponding to position 237; S at a position corresponding to position 238; I at a position corresponding to position 247; T at a position corresponding to position 257; P at a position corresponding to position 259; Y at a position corresponding to position 260; K at a position corresponding to position 261; N at a position corresponding to position 261; K at a position corresponding to position 263; R at a position corresponding to position 263; A at a position corresponding to position 269; L at a position corresponding to position 271; M at a position corresponding to position 271; T at a position corresponding to position 272; D at a position corresponding to position 276; S at a position corresponding to position 276; Y at a position corresponding to position 276; K at a position corresponding to position 277; R at a position corresponding to position 277; T at a position corresponding to position 277; H at a position corresponding to position 278; K at a position corresponding to position 278; N at a position corresponding to position 278; R at a position corresponding to position 278; S at a position corresponding to position 278; T at a position corresponding to position 278; Y at a position corresponding to position 278; M at a position corresponding to position 282; V at a position corresponding to position 291; A at a position corresponding to position 293; C at a position corresponding to position 293; F at a position corresponding to position 293; M at a position corresponding to position 293; P at a position corresponding to position 293; Q at a position corresponding to position 293; V at a position corresponding to position 293; E at a position corresponding to position 305; G at a position corresponding to position 308; N at a position corresponding to position 308; E at a position corresponding to position 309; L at a position corresponding to position 309; N at a position corresponding to position 309; Q at a position corresponding to position 309; R at a position corresponding to position 309; T at a position corresponding to position 309; A at a position corresponding to position 310; G at a position corresponding to position 310; K at a position corresponding to position 313; R at a position corresponding to position 313; H at a position corresponding to position 315; I at a position corresponding to position 317; K at a position corresponding to position 317; R at a position corresponding to position 317; M at a position corresponding to position 318; H at a position corresponding to position 320; K at a position corresponding to position 320; R at a position corresponding to position 320; R at a position corresponding to position 324; A at a position corresponding to position 325; D at a position corresponding to position 325; E at a position corresponding to position 325; G at a position corresponding to position 325; H at a position corresponding to position 325; K at a position corresponding to position 325; M at a position corresponding to position 325; N at a position corresponding to position 325; Q at a position corresponding to position 325; S at a position corresponding to position 325; V at a position corresponding to position 326; I at a position corresponding to position 328; K at a position corresponding to position 328; L at a position corresponding to position 328; S at a position corresponding to position 328; Y at a position corresponding to position 328; G at a position corresponding to position 347; S at a position corresponding to position 347; V at a position corresponding to position 353; with T at a position corresponding to position 359; R at a position corresponding to position 371; P at a position corresponding to position 377; T at a position corresponding to position 377; W at a position corresponding to position 380; Y at a position corresponding to position 380; K at a position corresponding to position 389; M at a position corresponding to position 392; R at a position corresponding to position 395; M at a position corresponding to position 399; T at a position corresponding to position 399; W at a position corresponding to position 399; G at a position corresponding to position 405; D at a position corresponding to position 407; Q at a position corresponding to position 407; A at a position corresponding to position 409; Q at a position corresponding to position 409; T at a position corresponding to position 410; P at a position corresponding to position 418; F at a position corresponding to position 419; I at a position corresponding to position 419; K at a position corresponding to position 419; R at a position corresponding to position 419; S at a position corresponding to position 419; H at a position corresponding to position 421; K at a position corresponding to position 421; N at a position corresponding to position 421; Q at a position corresponding to position 421; R at a position corresponding to position 421; S at a position corresponding to position 421; K at a position corresponding to position 425; A at a position corresponding to position 431; H at a position corresponding to position 431; K at a position corresponding to position 431; Q at a position corresponding to position 431; R at a position corresponding to position 431; S at a position corresponding to position 431; V at a position corresponding to position 431; L at a position corresponding to position 433; R at a position corresponding to position 433; T at a position corresponding to position 433; V at a position corresponding to position 433; K at a position corresponding to position 436; I at a position corresponding to position 437; M at a position corresponding to position 437; T at a position corresponding to position 438; V at a position corresponding to position 439; H at a position corresponding to position 440; R at a position corresponding to position 440; F at a position corresponding to position 441; R at a position corresponding to position 442; A at a position corresponding to position 443; M at a position corresponding to position 443; M at a position corresponding to position 445; P at a position corresponding to position 445; A at a position corresponding to position 446; D at a position corresponding to position 447; N at a position corresponding to position 447; and/or with Q at a position corresponding to position 447, each with reference to amino acid positions set forth in SEQ ID NO:3. The modified PH20 polypeptides can contain any one or more of the recited amino acid substitutions, in any combination, with or without additional modifications, so long at the PH20 polypeptide exhibits hyaluronidase activity, such as increased hyaluronidase activity compared to the PH20 polypeptide not containing the modification(s), for example, at least 1.5-fold increased hyaluronidase activity.

In some examples, the modified PH20 polypeptides provided herein contain one or more amino acid replacement(s) at a position(s) corresponding to position(s) 24, 29, 31, 48, 58, 69, 70, 75, 84, 97, 165, 166, 271, 278, 317, 320, 325, and/or 326 with reference to positions set forth in SEQ ID NO:3. For example, exemplary amino acid replacements include, but are not limited to, replacement with: E at a position corresponding to position 24; E at a position corresponding to position 29; V at a position corresponding to position 31; N at a position corresponding to position 48; K at a position corresponding to position 58; Q at a position corresponding to position 58; A at a position corresponding to position 69; F at a position corresponding to position 69; G at a position corresponding to position 69; P at a position corresponding to position 69; R at a position corresponding to position 69; A at a position corresponding to position 70; F at a position corresponding to position 70; G at a position corresponding to position 70; H at a position corresponding to position 70; H at a position corresponding to position 70; N at a position corresponding to position 70; R at a position corresponding to position 70; T at a position corresponding to position 70; V at a position corresponding to position 70; L at a position corresponding to position 75; T at a position corresponding to position 75; G at a position corresponding to position 84; G at a position corresponding to position 97; D at a position corresponding to position 165; L at a position corresponding to position 166; R at a position corresponding to position 166; T at a position corresponding to position 166; L at a position corresponding to position 271; H at a position corresponding to position 278; R at a position corresponding to position 278; K at a position corresponding to position 317; K at a position corresponding to position 320; E at a position corresponding to position 325, with G at a position corresponding to position 325; K at a position corresponding to position 325; N at a position corresponding to position 325; Q at a position corresponding to position 325; V at a position corresponding to position 326; each with reference to amino acid positions set forth in SEQ ID NO:3. The modified PH20 polypeptides can contain any one or more of the recited amino acid substitutions, in any combination, with or without additional modifications, so long at the PH20 polypeptide exhibits hyaluronidase activity, such as increased hyaluronidase activity compared PH20 polypeptide not containing the modification(s), for example, at least 2.0-fold increased hyaluronidase activity.

Exemplary modified PH20 polypeptides that exhibit increased activity compared to the unmodified PH20 polypeptide (e.g., set forth in SEQ ID NO:3) are any having the sequence of amino acids set forth in any of SEQ ID NOS: 73, 78, 86, 89, 91, 95, 96, 99, 100, 105, 106, 108, 109, 111, 112, 113, 115, 117, 118, 119, 120, 123-126, 128-136, 139-141, 149, 154, 155, 159, 164, 165, 167, 173, 178, 181, 191-193, 195-197, 199-205, 207-221, 225, 226, 228, 229, 231, 233, 237-239, 242, 247-254, 256, 257, 267, 269, 270, 277, 283, 293, 295, 296, 298, 300, 303, 308, 316, 318, 321, 322, 324, 325, 330, 334, 335, 338-340, 344, 348, 355, 367, 369, 371, 377, 384-388, 394, 398, 399, 401, 406-408, 410, 412, 414, 416, 419, 421-426, 428, 430, 431, 435, 448, 455, 456, 459, 462, 463, 465, 469, 478-480, 482, 484, 490, 493, 497, 501, 503, 505, 506-508, 510-512, 514, 518, 522, 523, 527, 531, 533, 537-543, 545, 551, 558, 559, 561, 563-566, 569, 572, 574, 576, 579, 581-583, 585, 587, 588, 594, 596, 602, 605, 606, 609, 613, 618-620, 624-634, 637, 640-644, 647, 648, 652, 657, 675, 695, 698, 699, 700, 712, 717, 725, 731, 732, 734, 738, 742, 746, 748-750, 757, 760, 762-765, 768-773, 775, 779, 782, 783, 786-789, 794-797, 799-801, 807, 814, 816, 819, 822, 825, 826, 830, 836, 838, 844, 847, 851, 853 or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 73, 78, 86, 89, 91, 95, 96, 99, 100, 105, 106, 108, 109, 111, 112, 113, 115, 117, 118, 119, 120, 123-126, 128-136, 139-141, 149, 154, 155, 159, 164, 165, 167, 173, 178, 181, 191-193, 195-197, 199-205, 207-221, 225, 226, 228, 229, 231, 233, 237-239, 242, 247-254, 256, 257, 267, 269, 270, 277, 283, 293, 295, 296, 298, 300, 303, 308, 316, 318, 321, 322, 324, 325, 330, 334, 335, 338-340, 344, 348, 355, 367, 369, 371, 377, 384-388, 394, 398, 399, 401, 406-408, 410, 412, 414, 416, 419, 421-426, 428, 430, 431, 435, 448, 455, 456, 459, 462, 463, 465, 469, 478-480, 482, 484, 490, 493, 497, 501, 503, 505, 506-508, 510-512, 514, 518, 522, 523, 527, 531, 533, 537-543, 545, 551, 558, 559, 561, 563-566, 569, 572, 574, 576, 579, 581-583, 585, 587, 588, 594, 596, 602, 605, 606, 609, 613, 618-620, 624-634, 637, 640-644, 647, 648, 652, 657, 675, 695, 698, 699, 700, 712, 717, 725, 731, 732, 734, 738, 742, 746, 748-750, 757, 760, 762-765, 768-773, 775, 779, 782, 783, 786-789, 794-797, 799-801, 807, 814, 816, 819, 822, 825, 826, 830, 836, 838, 844, 847, 851, 853 and contains the amino acid replacement and exhibits increased hyaluronidase activity compared to the corresponding unmodified polypeptide.

b. Increased Stability

Provided herein are PH20 polypeptides that exhibit increased stability. In particular, the PH20 polypeptides exhibit increased stability in vivo and/or in vitro. For example, the PH20 polypeptides can exhibit increased stability under various storage conditions. The modified PH20 polypeptides provided herein that exhibit increased stability display, among other parameters, increased resistance to denaturation conditions, including but not limited to, denaturation conditions caused by temperature (e.g., elevated temperature such as heat), agitation, no or low salt, and/or presence of excipients. Exemplary excipients include, but are not limited to, antiadherents, binders, coatings, fillers and diluents, flavors, colors, lubricants, glidants, preservatives, sorbents or sweeteners. For example, various excipients, such as preservatives, can act as protein denaturing agents. Modified PH20 polypeptides provided herein that exhibit increased protein stability exhibit reduced aggregation, reduced precipitation and/or increased activity when exposed to a denaturation condition compared to the corresponding PH20 not containing the amino acid replacement. For example, modified PH20 polypeptides provided herein exhibit at least or at least about or 10%, 20%, 30%, 40%, 50%, 60%, 70%, 80%, 90%, 100%, 110%, 120%, 130%, 140%, 150%, 200%, 250%, 300%, 350%, 400%), 450%, 500% or more increased activity when exposed to a denaturation condition compared to the corresponding PH20 polypeptide not containing the amino acid replacement when exposed to the same denaturation condition.

The PH20 polypeptides provided herein that exhibit increased stability are modified or variant PH20 polypeptides that contain an amino acid replacement (substitution), deletion or insertion or other modification. Typically, the PH20 polypeptides provided herein that exhibit increased stability contain one or more amino acid replacements in a PH20 polypeptide compared to the corresponding PH20 polypeptide not containing the amino acid replacement(s), for example, the PH20 polypeptide set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto. In particular, the modified or variant PH20 polypeptides provided herein exhibit increased stability compared to the corresponding PH20 polypeptide not containing the amino acid replacement, for example, the PH20 polypeptide set forth in any of SEQ ID NOS: 3, 7, 32-66, 69 or 72 and in particular the PH20 polypeptide set forth in SEQ ID NO:3.

In particular examples, the modified PH20 polypeptides contain an amino acid replacement at one or more amino acid positions identified as being associated with increased stability. As described herein, such positions can be identified using mutagenesis and selection or screening methods to identify those positions that result in stability (e.g., increased activity) of the polypeptide compared to the corresponding PH20 not containing the modification upon exposure to one or more denaturation conditions. The PH20 polypeptide also can contain other modifications, such as other amino acid replacements, that alone are not associated with conferring stability, so long as the resulting modified PH20 polypeptide exhibits increased stability under one or more denaturation conditions compared to the PH20 not containing the amino acid modification(s), such as amino acid replacement(s), and exhibits hyaluronidase activity. The modified PH20 polypeptide provided herein can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, or more amino acid replacements. Additional modifications, such as insertions or deletions, also can be included. The amino acid replacement can be in a PH20 polypeptide as set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto. For example, the replacements can be in a human PH20 polypeptide, for example, any set forth in any of SEQ ID NOS: 3, 7, 32-66, 69 or 72 or a variant thereof.

Exemplary of modified PH20 polypeptides provided herein are PH20 polypeptides that exhibit increased stability upon exposure to phenol compounds, high temperature (heat), and/or lack of NaCl.

i. Phenophiles

Provided herein are modified PH20 polypeptides that exhibit increased stability in the presence of phenolic compounds. Multidose formulations must contain antimicrobial preservatives to protect them from microbial contamination. For parenteral drug products, including insulin and other therapeutic agents, the most common preservatives are phenolic compounds, such as phenol, metacresol (m-cresol), benzyl alcohol, and parabens including methylparaben and propylparaben. The preservatives typically must be present at sufficient concentrations to satisfy regulatory rules. For example, regulatory requirements assert that the antimicrobial efficacy of the formulation must satisfy the preservative efficacy test (PET) requirements of the target markets. Currently different regulatory agencies have different pharmacopeial criteria for antimicrobial effectiveness for pharmaceutical products designed for multiple dosing. The PET requirements of the United States Pharmacopoeia (USP) and the European Pharmacopoeia (EP) differ considerably, imposing additional constraints in developing multidose formulations. Table 4 shows the criteria for injectable drugs to meet USP and EP criteria. Typically, formulations that meet EP (EPA or EPB) anti-microbial requirements contain more preservative than those formulated only to meet USP anti-microbial requirements.

TABLE 4

USP and EP requirement for antimicrobial effectiveness testing

| | | | Europe | |
|---|---|---|---|---|
| Requirement | Time point | United States USP | EPB (Minimum) | EPA (Preferred) |
| Bacterial Log Reduction* | 6 h | | | 2 |
| | 24 h | | 1 | 3 |
| | 7 d | 1.0 | 3 | No recovery |
| | 14 d | 3.0 | No increase | No recovery |
| | 28 d | No increase | No increase | No recovery |
| Fungal Log Reduction* | 7 d | No increase | | 2 |
| | 14 d | No increase | 1 | No increase |
| | 28 d | No increase | No increase | No increase |

*$Log_{10}$ unit reduction from initial measured inoculum; No increase: not more than 0.5 $log_{10}$ unit increase than previously measured value.

Anti-microbial preservatives can interact with proteins resulting in aggregations and negative effects on stability. Thus, although a necessary component, preservatives pose a significant problem in the development of stable, multidose formulations of proteins because they typically induce aggregation of the protein in aqueous solution. In particular, increasing or high amounts of preservatives can negatively impact the stability of a protein, including effects on physical stability (aggregation or precipitation) that can impact protein activity. For example, to meet the EP preservative efficacy requirements, relatively high amounts of phenolic compounds, such as phenol or m-cresol, can be required, which can influence stability of the protein formulation. For example, preservatives such as phenol, m-cresol, and benzyl alcohol have been shown to induce aggregation of human growth hormone (Maa and Hsu (1996) *Int. J. Pharm.* 140:155-168), recombinant interleukin-1 receptor (Remmele (1998) *Pharm. Res.* 15:200-208), human insulin-like growth factor I (Fransson (1997) *Pharm. Res.* 14:606-612), rhIFN-γ (Lam (1997) *Pharm. Res.* 14:725-729) and cytochrome c (Singh et al. (2011) *J. Pharm Sci.,* 100:1679-89). The destabilizing effect that preservatives have on proteins in solution has been a limiting factor in the development of multidose formulations, and to date, most protein therapeutics have been formulated for single use only.

PH20 hyaluronidase, such as rHuPH20, rapidly loses activity in the presence of preservatives, likely due to unfolding of the protein and subsequent aggregate formation. For example, as shown in the Examples herein, preservatives reduce PH20 enzymatic activity, particularly at elevated temperatures (see also U.S. Provisional Appl. No. 61/520,962; and U.S. application Ser. Nos. 13/507,263 and 13/507,262). For example, following incubation with 0.4% m-cresol for 4 hours, PH20 (e.g., rHuPH20) retains only about 10% of its activity (see e.g., Example 5). When incubated in the presence of 0.1% phenol and 0.15% or 0.315% m-cresol for 6 days at 37° C., PH20 (e.g., rHuPH20) retains about 0% to 15% activity, depending on the presence of other excipients or amounts of other excipients in the formulation (see e.g., Examples 9 and 10). For example, the presence of a higher concentration of salt generally increases the stability of PH20. In particular, the melting temperature of PH20, such as rHuPH20, is reduced significantly when phenolic preservatives, such as m-Cresol, are added to the formulation. For example, the unfolding temperature of rHuPH20 is reduced from 44° C. to 24° C. The lower PH20 unfolding temperatures leads to increased PH20 aggregation, especially at elevated temperatures, and reduced enzyme activity. The destabilizing effect is likely due to the hydrophobic nature of the phenolic preservatives. The hydrophobicity of the phenolic compounds can lead to interaction with rHuPH20 through nonspecific binding to the protein, ultimately perturbing the structural integrity of rHuPH20. This translates to a significant loss of rHuPH20 enzymatic activity in the presence of preservatives.

The modified PH20 polypeptides provided herein that exhibit increased stability in the presence of phenolic preservatives exhibit more than 15% enzymatic activity in the presence of at least one phenolic preservative for at least 4 hours, 5 hours, 6 hours, 7 hours, 8 hours, 9 hours, 10 hours, 11 hours, 12 hours, 24 hours, 2 days, 3 days, 4 days, 5 days, 6 days, 7 days, 8 days, 9 days, 10 days, 11 days, 12 days, 13 days, 14 days, 3 weeks, 4 weeks or more compared to the enzymatic activity of the modified PH20 polypeptide in the absence of preservative for the same time period and under the same conditions (except for the presence of preservative). In some examples, the modified PH20 polypeptides provided herein exhibit at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of a phenolic preservative compared to in the absence of preservative. For example, the phenolic preservative compound can be phenol, metacresol (m-cresol), benzyl alcohol, and/or parabens including methylparaben or propylparaben.

In particular examples, the increased stability in the presence of preservative is exhibited under temperature conditions of between or about between 0° C. to 40° C., such as between or about between 2° C. to 6° C., 24° C. to 32° C. or 35° C. to 40° C., and generally at or about at 4° C. or 5° C., 30° C. or 37° C. It is understood that since high temperature also can have a destabilizing effect on PH20 activity (see below), the percentage of enzymatic activity of a modified PH20 polypeptide provided herein in the presence of preservative is greater at lower temperatures than at higher temperatures.

Generally, the modified PH20 polypeptides provided herein exhibit increased stability, and the noted enzymatic activities, in the presence of an anti-microbial effective amount of preservative that kills or inhibits the propagation of microbial organisms in a sample of the composition. For example, the modified PH20 polypeptides provided herein exhibit increased stability in the presence of an anti-microbial effective amount of preservative that kills or inhibits the propagation of microbial organisms such that at least a 1.0 log 10 unit reduction in bacterial organisms occurs at 7 days following inoculation. In some examples, the modified PH20 polypeptides provided herein exhibit increased stability in the presence of an anti-microbial effective amount of preservative that kills or inhibits the propagation of microbial organisms such that, when tested in an antimicrobial preservative effectiveness test (APET), following inoculation of the composition with a microbial inoculum there is at least a 1.0 log 10 unit reduction in bacterial organisms at 7 days following inoculation, at least a 3.0 log 10 unit reduction of bacterial organisms at 14 days following inoculation, at least no further increase in bacterial organisms after 28 days following inoculation, and at least no increase in fungal organisms after 7 days following inoculation. In other examples, the modified PH20 polypeptides provided herein exhibit increased stability in the presence of an anti-microbial effective amount of preservative that kills or inhibits the propagation of microbial organisms such that, when tested in an antimicrobial preservative effectiveness test (APET), following inoculation of the composition with a microbial inoculum there is at least a 1.0 log 10 unit reduction of bacterial organisms at 24 hours following inoculation, at least a 3.0 log 10 unit reduction of bacterial organisms at 7 days following inoculation, no further increase in bacterial organisms after 28 days following inoculation, at least a 1.0 log 10 unit reduction of fungal organisms at 14 days following inoculation, and at least no further increase in fungal organisms after 28 days following inoculation. In yet another example, the modified PH20 polypeptides provided herein exhibit increased stability in the presence of an anti-microbial effective amount of the preservative that kills or inhibits the propagation of microbial organisms such that, when tested in an antimicrobial preservative effectiveness test (APET), following inoculation of the composition with a microbial inoculum there is at least a 2.0 log 10 unit reduction of bacterial organisms at 6 hours following inoculation, at least a 3.0 log 10 unit reduction of bacterial organisms at 24 hours following inoculation, no recovery of bacterial organisms after 28 days following inoculation of the composition with the microbial inoculum, at least a 2.0 log 10 unit reduction of fungal organisms at 7 days following inoculation, and at least no further increase in fungal organisms after 28 days following inoculation.

For example, the modified PH20 polypeptides provided herein exhibit increased stability, and above recited enzymatic activity, in the presence of a total amount of one or more phenolic preservative agents as a percentage (%) of mass concentration (w/v) that is or is between 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4% inclusive.

Generally, modified PH20 polypeptides provided herein exhibit increased stability in the presence of m-cresol and/or phenol. For example, modified PH20 polypeptides provided herein exhibit increased stability in the presence of m-cresol in an amount as a % of mass concentration (w/v) in a formulation containing the modified PH20 polypeptide of between or about between 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4%. In other examples, modified PH20 polypeptides provided herein exhibit increased stability in the presence of phenol in an amount at a % of mass concentration (w/v) in a formulation containing the modified PH20 polypeptide of between or about between 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4% m-cresol. In further examples, modified PH20 polypeptides provided herein exhibit increased stability in the presence of phenol and m-cresol in an amount as a % of mass concentration (w/v) in a formulation containing the modified PH20 polypeptide of between or about between 0.05% to 0.25% phenol and between or about between 0.05% to 0.3% m-cresol, between or about between 0.10% to 0.2% phenol and between or about between 0.6% to 0.18% m-cresol, between or about between 0.1% to 0.15% phenol and 0.8% t 0.15% m-cresol, between or about between 0.10% to 0.15% phenol and between or about between 0.06% to 0.09% m-cresol, or between or about between 0.12% to 0.18% phenol and between or about between 0.14% to 0.22% m-cresol.

In examples herein, modified PH20 polypeptides exhibit more than 15%, such as at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of at least about between or between 0.3% to 0.4%, inclusive, m-cresol and/or phenol for at least 4 hours at 37° C. compared to the enzymatic activity of the modified PH20 polypeptide in the absence of the preservative for the same time period and under the same conditions (except for the presence of preservative). For example, modified PH20 polypeptides exhibit more than 15%, such as at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of about or 0.4% m-cresol for at least 4 hours at 37° C. compared to the enzymatic activity of the modified PH20 polypeptide in the absence of the preservative for the same time period and under the same conditions (except for the presence of preservative). Modified PH20 polypeptides provided herein also exhibit more than 15%, such as at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of at least about between or between 0.2% to 0.4%, inclusive, m-cresol and/or phenol for at least 1 day, 2 days, 3 days, 4 days, 5 days or 6 days at 37° C. compared to the enzymatic activity of the modified PH20 polypeptide in the absence of preservative for the same time period and under the same conditions (except for the presence of preservative). For example, modified PH20 polypeptides provided herein exhibit more than 15%, such as at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of about or 0.10% phenol and about or 0.15% m-cresol for at least 1 day, 2 days, 3 days, 4 days, 5 days or 6 days at 37° C. compared to the enzymatic activity of the modified PH20 polypeptide in the absence of preservative for the same time period and under the same conditions (except for the presence of preservative). In other examples, modified PH20 polypeptides provided herein exhibit more than 15%, such as at least 16%, 17%, 18%, 19%, 20%, 25%, 30%, 35%, 40%, 45%, 50%, 55%, 60%, 65%, 65%, 70%, 75%, 80%, 85%, 90%, 95% or more enzymatic activity in the presence of about or 0.315% m-cresol for at least 1 day, 2 days, 3 days, 4 days, 5 days or 6 days, generally for at least 6 days, at 37° C. compared to the enzymatic activity of the modified PH20 polypeptide in the absence of preservative for the same time period and under the same conditions (except for the presence of preservative).

For example, such modified PH20 polypeptides provided herein that exhibit increased stability to phenol compounds contain an amino acid replacement (substitution) at one or more amino acid positions corresponding to positions 10, 12, 20, 22, 26, 34, 36, 46, 50, 52, 58, 68, 70, 74, 82, 83, 84, 86, 97, 127, 131, 138, 142, 143, 144, 166, 169, 174, 193, 195, 196, 204, 205, 206, 213, 219, 234, 237, 238, 240, 249, 261, 267, 277, 279, 291, 309, 310, 314, 315, 317, 318, 347, 367, 375, 376, 399, 401, 407, 416, 419, 421, 431, 433, 439, 440, 443 or 445 with reference to amino acid positions set forth in SEQ ID NO:3. For example, the amino acid positions can be replacements at one or more positions corresponding to replacement of (P) at position 10 (P10), V12, A20, S22, L26, D34, S36, I46, G50, G52, V58, D68, I70, T74, K82, I83, S84, Q86, T97, D127, N131, Q138, V142, Q143, L144, V166, I169, L174, H193, K195, K196, F204, N205, V206, D213, N219, Q234, V237, A238, T240, E249, S261, A267, V277, K279, G291, I309, M310, K314, S315, L317, Q347, P367, E375, K376, Y399, S401, S407, D416, A419, D421, D431, F433, E439, T440, P443 or I445 with reference to amino acid positions set forth in SEQ ID NO:3.

Exemplary of amino acid replacements in the modified PH20 polypeptides provided herein include, but are not limited to, replacement with: glycine (G) at a position corresponding to position 10; K at a position corresponding to position 12; S at a position corresponding to position 20; T at a position corresponding to position 22; M at a position corresponding to position 26; W at a position corresponding to position 34; N at a position corresponding to position 36; L at a position corresponding to position 46; M at a position corresponding to position 50; T at a position corresponding to position 52; S at a position corresponding to position 52; C at a position corresponding to position 58; K at a position corresponding to position 58; R at a position corresponding to position 58; N at a position corresponding to position 58; Y at a position corresponding to position 58; P at a position corresponding to position 58; H at a position corresponding to position 58; P at a position corresponding to position 68; V at a position corresponding to position 70; E at a position corresponding to position 74; L at a position corresponding to position 82; N at a position corresponding to position 82; V at a position corresponding to position 83; Q at a position corresponding to position 83; S at a position corresponding to position 83; G at a position corresponding to position 83; N at a position corresponding to position 84; A at a position corresponding to position 86; K at a position corresponding to position 86; E at a position corresponding to position 97; L at a position corresponding to position 97; R at a position corresponding to position 127; R at a position corresponding to position 131; L at a position corresponding to position 138; K at a position corresponding to position 142; N at a position corresponding to position 142; P at a position corresponding to position 142; S at a position corresponding to position 142; T at a position corresponding to position 142; G at a position corresponding to position 143; K at a position corresponding to position 143; T at a position corresponding to position 144; Q at a position corresponding to position 166; T at a position corresponding to position 166; L at a position corresponding to position 169; G at a position corresponding to position 174; N at a position corresponding to position 174; Q at a position corresponding to position 193; T at a position corresponding to position 195; N at a position corresponding to position 195; E at a position corresponding to position 196; R at a position corresponding to position 196; P at a position corresponding to position 204; A at a position corresponding to position 205; E at a position corresponding to position 205; I at a position corresponding to position 206; A at a position corresponding to position 213; I at a position corresponding to position 219; M at a position corresponding to position 234; T at a position corresponding to position 237; H at a position corresponding to position 238; Q at a position corresponding to position 240; V at a position corresponding to position 249; A at a position corresponding to position 261; K at a position corresponding to position 261; T at a position corresponding to position 267; K at a position corresponding to position 277; H at a position corresponding to position 279; V at a position corresponding to position 279; V at a position corresponding to position 291; E at a position corresponding to position 309; Q at a position corresponding to position 310; Y at a position corresponding to position 314; Y at a position corresponding to position 315; N at a position corresponding to position 317; W at a position corresponding to position 317; D at a position corresponding to position 318; G at a position corresponding to position 347; A at a position corresponding to position 367; R at a position corresponding to position 375; R at a position corresponding to position 376; V at a position corresponding to position 399; E at a position corresponding to position 401; A at a position corresponding to position 407; L at a position corresponding to position 416; K at a position corresponding to position 419; H at a position corresponding to position 421; E at a position corresponding to position 431; T at a position corresponding to position 433; V at a position corresponding to position 433; C at a position corresponding to position 439; P at a position corresponding to position 440; G at a position corresponding to position 443; N at a position corresponding to position 445, each with reference to amino acid residue positions set forth in SEQ ID NO:3.

The amino acid replacements) can be in a PH20 polypeptide as set forth in any of SEQ ID NOS: 2, 3, 6-66, 68-72, 856-861, 869 or 870 or a variant thereof having at least 75%, 80%, 81%, 82%, 83%), 84%, 85%, 86%, 86%, 88%, 89%, 90%, 91%, 92%, 93%, 94%, 95%, 96%, 97%, 98%, 99% or more sequence identity thereto. For example, the replacement(s) can be in a human PH20 polypeptide, for example, any set forth in any of SEQ ID NOS: 3, 7, 32-66, 69 or 72 or a variant thereof.

Exemplary modified PH20 polypeptides that exhibit increased stability to phenol compounds compared to the unmodified PH20 polypeptide (e.g., set forth in SEQ ID NO:3) are any having the sequence of amino acids set forth in any of SEQ ID NOS: 83, 88, 93, 94, 101, 144, 148, 158, 171, 176, 175, 177, 178, 180, 182, 183, 184, 185, 194, 221, 240, 259, 260, 261, 262, 263, 264, 268, 270, 272, 307, 309, 327, 334, 341, 351, 352, 353, 356, 357, 358, 359, 361, 424, 426, 430, 434, 436, 443, 444, 445, 446, 447, 449, 450, 451, 454, 461, 467, 480, 487, 489, 492, 495, 504, 505, 509, 527, 544, 576, 589, 600, 603, 607, 612, 614, 647, 658, 683, 687, 733, 736, 741, 754, 763, 768, 781, 796, 797, 809, 818, 829 or 837 or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 83, 88, 93, 94, 101, 144, 148, 158, 171, 176, 175, 177, 178, 180, 182, 183, 184, 185, 194, 221, 240, 259, 260, 261, 262, 263, 264, 268, 270, 272, 307, 309, 327, 334, 341, 351, 352, 353, 356, 357, 358, 359, 361, 424, 426, 430, 434, 436, 443, 444, 445, 446, 447, 449, 450, 451, 454, 461, 467, 480, 487, 489, 492, 495, 504, 505, 509, 527, 544, 576, 589, 600, 603, 607, 612, 614, 647, 658, 683, 687, 733, 736, 741, 754, 763, 768, 781, 796, 797, 809, 818, 829 or 837 and contains the amino acid replacement, exhibits hyaluronidase activity and exhibits increased stability in the presence phenol compounds compared to the corresponding unmodified polypeptide.

In particular, provided herein is a modified PH20 polypeptide that contains an amino acid replacement with P at a position corresponding to amino acid residue 204 with reference to SEQ ID NO:3. Typically, the modified PH20 polypeptide is a human polypeptide. For example, provided herein is a modified PH20 polypeptide that contains an amino acid replacement F204P in a sequence of amino acids set forth in any of SEQ ID NOS: 3, 7, 69, 72 or 32-66, or a sequence of amino acids that exhibits at least 75%, 80%, 85%, 90%, 91%, 92%, 93%, 94%, 95%, 96%, 97%, 98%, 99% or more sequence identity to any of SEQ ID NOS:3, 7, 69, 72 or 32-66 so long as the modified polypeptide contains the amino acid replacement corresponding to F204P. In other cases, the modified PH20 polypeptide is a non-human polypeptide. For example, provided herein is a modified PH20 polypeptide that contains an amino acid replacement F204P in a sequence of amino acids set forth in SEQ ID NO: 10, 12, 14, 857, 859, 861 or 870 or a sequence that exhibits at least 75%, 80%, 85%, 90%, 91%, 92%, 93%, 94%, 95%, 96%, 97%, 98%, 99% or more sequence identity to any of SEQ ID NOS: 10, 12, 14, 857, 859, 861 or 870 so long as the modified polypeptide contains the amino acid replacement corresponding to F204P. In a further example, provided herein is a modified PH20 polypeptide that contains an amino acid replacement F205P in a sequence of amino acids set forth in SEQ ID NO:24 or Y204P in SEQ ID NO:31, or a sequence that exhibits at least 75%, 80%, 85%, 90%, 91%, 92%, 93%, 94%, 95%, 96%, 97%, 98%, 99% or more sequence identity to SEQ ID NO:24 or 31. Exemplary of such a modified PH20 polypeptide is a polypeptide having the sequence of amino acids set forth in SEQ ID NO:449, or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to SEQ ID NO:449 and contains the amino acid replacement F204P, exhibits increased hyaluronidase activity and exhibits increased stability to phenol compounds compared to the corresponding unmodified polypeptide (e.g., SEQ ID NO:3). In any of the above examples, the modified PH20 polypeptide that contains an amino acid replacement with P at a position corresponding to amino acid residue 204 with reference to SEQ ID NO:3 does not have the sequence of amino acids set forth in SEQ ID NO:15-22, 28 or 29.

In another example, provided herein is a modified PH20 polypeptide that contains an amino acid replacement at a position corresponding to amino acid residue 58 with reference to SEQ ID NO:3. Exemplary of amino acid replacements are replacement with lysine (K) or with arginine (R) at a position corresponding to amino acid residue 58 with reference to SEQ ID NO:3. Typically, the modified PH20 polypeptide is a human polypeptide. For example, provided herein is a modified PH20 polypeptide that contains an amino acid replacement V58K or V58R in a sequence of amino acids set forth in any of SEQ ID NOS: 3, 7, 69, 72 or 32-66, or a sequence of amino acids that exhibits at least 75%, 80%, 85%, 90%, 91%, 92%, 93%, 94%, 95%, 96%, 97%, 98%, 99% or more sequence identity to any of SEQ ID NOS:3, 7, 69, 72 or 32-66. In other cases, the modified PH20 polypeptide is a non-human polypeptide. For example, provided herein is a modified PH20 polypeptide that contains an amino acid replacement V58K or V58R in a sequence of amino acids set forth in SEQ ID NO: 10, 12, 14, 20, 22, 24, 29, 857, 859, 861 or 870 or a sequence that exhibits at least 75%, 80%, 85%, 90%, 91%, 92%, 93%, 94%, 95%, 96%, 97%, 98%, 99% or more sequence identity to any of SEQ ID NOS: 10, 12, 14, 20, 22, 24, 29, 857, 859, 861 or 870. En a further example, provided herein is a modified PH20 polypeptide that contains an amino acid replacement A58R in a sequence of amino acids set forth in SEQ ID NO:16 or 31, or a sequence that exhibits at least 75%, 80%, 85%, 90%, 91%, 92%, 93%, 94%, 95%, 96%, 97%, 98%, 99% or more sequence identity to SEQ ID NO:16 or 31. Exemplary of such a modified PH20 polypeptide is a polypeptide having the sequence of amino acids set forth in SEQ ID NO:182, or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to SEQ ID NO:182, which contains the amino acid replacement V58R and exhibits increased hyaluronidase activity and exhibits increased stability in the presence of phenol compounds compared to the corresponding unmodified polypeptide (e.g., SEQ ID NO:3).

ii. Thermophiles

At elevated temperatures, PH20 hyaluronidases can lose activity. Provided herein are modified PH20 polypeptides that exhibit increased stability at elevated temperatures of between or about between 30° C. to 45° C., inclusive, such as between or about between 35° C. to 42° C., in particular at or about 37° C. For example, provided herein are modified PH20 polypeptides that are stable at elevated temperatures greater than 32° C. such as 35° C. to 45° C., 37° C. to 42° C. and in particular at or about 37° C. for at least 3 hours, 4 hours, 5 hours, 6 hours, 12 hours, 1 day, 2 days, 3 days, 4 days, at least 5 days, at least 6 days or at least 7 days. Modified PH20 polypeptides that exhibit stability at elevated temperatures can be used in applications where temperatures are elevated, can fluctuate or can increase. This can occur, for example, in methods of administration utilizing pumps or other continuous infusion devices.

In particular, modified PH20 polypeptides provided herein that exhibit stability at elevated temperatures exhibit increased hyaluronidase activity at elevated temperature compared to the corresponding PH20 polypeptide not containing the modification, e.g., amino acid replacement. The PH20 polypeptides can exhibit increased hyaluronidase activity upon incubation at elevated temperatures greater than 32° C. such as 35° C. to 45° C. or 37° C. to 42° C., in particular at or about 37° C. for at least 4 hours, 5 hours, 6 hours, 12 hours, 1 day, 2 days, 3 hours, 4 hours, 5 hours, 6 hours, 12 hours, 1 day, 2 days, 3 days, 4 days, at least 5 days, at least 6 days or at least 7 days compared to the corresponding PH20 polypeptide not containing the modification incubated under the same conditions. For example, the hyaluronidase activity can be increased at least 10%, 20%, 30%, 40%, 50%, 60%, 70%, 80%, 90%, 100%, 200%, 300%, 400%, 500% or more compared to the corresponding PH20 polypeptide not containing the modification incubated under the same conditions. For example, the hyaluronidase activity can be increased at least 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold or more compared to the corresponding PH20 polypeptide not containing the modification incubated under the same conditions.

In other examples, modified PH20 polypeptides provided herein that exhibit stability at elevated temperatures retain hyaluronidase activity at elevated temperatures compared to the activity of the modified PH20 polypeptide incubated at non-elevated temperatures under the same conditions (except for the differences in temperature). For example, modified PH20 polypeptides exhibit greater than or about 50%, such as greater than or at least 55%, 60%, 65%, 70%, 80%, 90%, 91%, 92%, 93%, 94%, 95%, 96%, 97%, 98%, 99% or 100% of the activity at elevated temperatures greater than 32° C. such as 35° C. to 45° C. or 37° C. to 42° C., in particular at or about 37° C. compared to the activity of the PH20 at non-elevated temperatures of between or about between 2° C. to 8° C. In some examples, modified PH20 polypeptides provided herein that exhibit stability at elevated temperatures exhibit increased activity at elevated temperatures compared to the activity of the modified PH20 polypeptide incubated at non-elevated temperatures under the same conditions (except for the difference in temperature). For example, modified PH20 polypeptides exhibit greater than or about 10% increased activity, such as greater than or at least 20%, 30%, 40%, 50%, 60%, 70%, 80%, 90%, 100%, 200%, 300%, 400%, 500% or more of activity at elevated temperatures greater than 32° C. such as 35° C. to 45° C. or 37° C. to 42° C., in particular at or about 37° C. compared to the activity of the PH20 at non-elevated temperatures of between or about between 2° C. to 8° C. For example, modified PH20 polypeptides exhibit greater than or at least about 1.1-fold the hyaluronidase activity, such as greater than or at least 1.2-fold, 1.3-fold, 1.4-fold, 1.5-fold, 1.6-fold, 1.7-fold, 1.8-fold, 1.9-fold, 2-fold, 3-fold, 4-fold, 5-fold or more of activity at elevated temperatures greater than 32° C. such as 35° C. to 45° C. or 37° C. to 42° C., in particular at or about 37° C. compared to the activity of the PH20 at non-elevated temperatures of between or about between 2° C. to 8° C.

For example, such modified PH20 polypeptides provided herein that exhibit increased stability at elevated temperatures contain an amino acid replacement (substitution) at one or more amino acid positions corresponding to positions 1, 11, 12, 14, 20, 26, 29, 34, 50, 58, 70, 82, 83, 84, 86, 87, 140, 142, 143, 147, 152, 166, 167, 172, 174, 178, 193, 195, 206, 212, 213, 219, 233, 237, 240, 267, 277, 291, 292, 309, 313, 314, 317, 318, 347, 367, 368, 371, 374, 389, 392, 395, 396, 406, 419, 421, 439 or 443 with reference to amino acid positions set forth in SEQ ID NO:3. For example, the amino acid positions can be replacements at one or more positions corresponding to replacement of (L) at position 1 (L1), N11, V12, F14, A20, L26, F29, D34, G50, V58, I70, K82, I83, S84, Q86, D87, Q140, V142, Q143, T147, K152, V166, E167, G172, L174, N178, H193, K195, V206, D212, D213, N219, Q233, V237, T240, A267, V277, G291, E292, I309, M313, K314, L317, L318, Q347, P367, D368, A371, L374, E389, E392, S395, E396, L406, A419, D421, E439 or P443, with reference to amino acid positions set forth in SEQ ID NO:3. The resulting modified PH20 polypeptide exhibits increased stability at elevated temperatures greater than 32° C. such as 35° C. to 45° C., 37° C. to 42° C. and in particular at or about 37° C. for at least 3 hours, 4 hours, 5 hours, 6 hours, 12 hours, 1 day, 2 days, 3 days, 4 days, at least 5 days, at least 6 days, at least 7 days or more.

Exemplary amino acid replacements in the modified PH20 polypeptides provided herein include, but are not limited, replacement with: R at a position corresponding to position 1; S at a position corresponding to position 11; I at a position corresponding to position 12; V at a position corresponding to position 14; S at a position corresponding to position 20; M at a position corresponding to position 26; with R at a position corresponding to position 29; W at a position corresponding to position 34; M at a position corresponding to position 50; K at a position corresponding to position 58; Q at a position corresponding to position 58; Q at a position corresponding to position 58; V at a position corresponding to position 70; L at a position corresponding to position 82; Q at a position corresponding to position 83; R at a position corresponding to position 84; A at a position corresponding to position 86; S at a position corresponding to position 87; K at a position corresponding to position 140; S at a position corresponding to position 142; T at a position corresponding to position 142; K at a position corresponding to position 143; S at a position corresponding to position 147; T at a position corresponding to position 152; T at a position corresponding to position 166; D at a position corresponding to position 167; A at a position corresponding to position 172; G at a position corresponding to position 174; N at a position corresponding to position 174; R at a position corresponding to position 178; Q at a position corresponding to position 193; T at a position corresponding to position 195; I at a position corresponding to position 206; S at a position corresponding to position 212; A at a position corresponding to position 213; I at a position corresponding to position 219; G at a position corresponding to position 233; T at a position corresponding to position 237; A at a position corresponding to position 240; Q at a position corresponding to position 240; T at a position corresponding to position 267; E at a position corresponding to position 277; S at a position corresponding to position 291; H at a position corresponding to position 292; V at a position corresponding to position 292; S at a position corresponding to position 309; H at a position corresponding to position 313; S at a position corresponding to position 314; I at a position corresponding to position 317; T at a position corresponding to position 317; W at a position corresponding to position 317; R at a position corresponding to position 318; G at a position corresponding to position 347; A at a position corresponding to position 367; R at a position corresponding to position 368; S at a position corresponding to position 371; P at a position corresponding to position 374; A at a position corresponding to position 389; V at a position corresponding to position 392; A at a position corresponding to position 395; H at a position corresponding to position 396; N at a position corresponding to position 406; H at a position corresponding to position 419; K at a position corresponding to position 419; R at a position corresponding to position 421; S at a position corresponding to position 421; A at a position corresponding to position 439; C at a position corresponding to position 439; or G at a position corresponding to position 443, each with reference to amino acid residue positions set forth in SEQ ID NO:3.

The amino acid replacements) can be in a PH20 polypeptide as set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto. For example, the replacement(s) can be in a human PH20 polypeptide, for example, any set forth in any of SEQ ID NOS: 3, 7, 32-66, 69 or 72 or a variant thereof.

Exemplary modified PH20 polypeptides that exhibit increased stability to phenol compounds compared to the unmodified PH20 polypeptide (e.g., set forth in SEQ ID NO:3) are any having the sequence of amino acids set forth in any of SEQ ID NOS: 79, 85, 87, 90, 93, 101, 114, 144, 171, 178, 181, 221, 259, 262, 269, 270, 282, 343, 356, 357, 359, 368, 395, 426, 429, 432, 434, 436, 441, 443, 444, 454, 460, 461, 467, 477, 487, 491, 492, 509, 525, 550, 554, 557, 584, 593, 599, 605, 611, 612, 617, 647, 658, 667, 676, 679, 709, 720, 723, 727, 740, 761, 763, 772, 773, 808, 809, or 829 or having a sequence of amino acids that exhibits at least 68%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 79, 85, 87, 90, 93, 101, 114, 144, 171, 178, 181, 221, 259, 262, 269, 270, 282, 343, 356, 357, 359, 368, 395, 426, 429, 432, 434, 436, 441, 443, 444, 454, 460, 461, 467, 477, 487, 491, 492, 509, 525, 550, 554, 557, 584, 593, 599, 605, 611, 612, 617, 647, 658, 667, 676, 679, 709, 720, 723, 727, 740, 761, 763, 772, 773, 808, 809, or 829 and contains the amino acid replacement, exhibits hyaluronidase activity and exhibits increased stability to elevated temperatures compared to the corresponding unmodified polypeptide.

iii. Absence of Salt

PH20 denatures in the presence of low salt or no salt. Thus, PH20 requires a high salt concentration of between or about between 140 mM to 200 mM to maintain stability. Other therapeutic agents, for example insulin, exhibit decreased solubility and increased crystallization/aggregation in the presence of high salt. Thus, the high salt requirements of PH20 can affect the solubility and/or activity of co-formulated therapeutic agents, while the presence of low salt can decrease the activity of PH20. This can create problems for generating PH20 co-formulations.

Provided herein are modified PH20 polypeptides that exhibit increased stability in the presence of low concentrations of salt (e.g. NaCl) less than 100 mM, for example, less than 90 mM, 80 mM, 70 mM, 60 mM, 50 mM, 40 mM, 30 mM, 25 mM, 20 mM, 15 mM, 10 mM, 5 mM or less. Generally, the modified PH20 polypeptides provided herein exhibit stability in the presence of low concentrations of salt, for example, low concentrations of NaCl of between or about between 10 mM NaCl and 100 mM NaCl, such as between or about between 15 mM to 80 mM NaCl. The modified PH20 polypeptides provided herein that exhibit stability at low concentrations of salt, such as low concentrations of NaCl (i.e., less than 100 mM or less), exhibit increased hyaluronidase activity compared to the corresponding PH20 not containing the modification(s) (e.g., amino acid replacements). For example, modified PH20 polypeptides exhibit greater than or about 10% increased activity, such as greater than or at least 20%, 30%, 40%, 50%, 60%, 70%, 80%, 90%, 100%, 200%, 300%, 400%, 500% or more of activity at low concentrations of salt, such as low concentrations of NaCl (i.e., less than 100 mM), compared to the activity of the corresponding PH20 not containing the amino acid modification(s) (e.g., amino acid replacement(s) under the same conditions). For example, modified PH20 polypeptides exhibit greater than or at least about 1.1-fold the hyaluronidase activity, such as greater than or at least 1.2-fold, 1.3-fold, 1.4-fold, 1.5-fold, 1.6-fold, 1.7-fold, 1.8-fold, 1.9-fold, 2-fold, 3-fold, 4-fold, 5-fold or more of activity at low concentrations of NaCl less than 100 mM compared to the activity of the corresponding PH20 not containing the amino acid modification(s) (e.g., amino acid replacement(s) under the same conditions).

2. Inactive Mutants

Provided herein are modified PH20 polypeptides that contain one or more amino acid replacements in a PH20 polypeptide and that are inactive, whereby the polypeptides do not exhibit hyaluronidase activity or exhibit low or diminished hyaluronidase activity. The modified PH20 polypeptides provided herein that are inactive generally exhibit less than 20%, such as less than 10%, of the hyaluronidase activity of a wildtype or reference PH20 polypeptide, such as the polypeptide set forth in SEQ ID NO: 3 or 7. For example, modified PH20 polypeptides provided herein that are inactive exhibit less than 9%, 8%, 7%, 6%, 5%, 4%, 3%, 2%, 1%, 0.9%, 0.8%, 0.7%, 0.6%, 0.5%, 0.4%, 0.3%, 0.2%, 0.1%, 0.05% or less of the hyaluronidase activity of a wildtype or reference PH20 polypeptide, such as the corresponding polypeptide not containing the amino acid modification (e.g., amino acid replacement), for example, a polypeptide set forth in SEQ ID NO:3 or 7.

For example, provided herein are PH20 polypeptides that are inactive and that are modified, for example by amino acid replacement or substitution, compared to a wildtype or reference PH20 polypeptide. For example, a modified PH20 polypeptide provided herein that is inactive contains one or more amino acid replacements at position(s) corresponding to position 2, 3, 4, 5, 6, 7, 8, 9, 10, 11, 12, 13, 14, 15, 16, 17, 18, 19, 20, 21, 22, 23, 25, 27, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 94, 95, 96, 98, 99, 100, 101, 102, 103, 104, 105, 106, 107, 108, 109, 110, 111, 112, 113, 114, 115, 116, 117, 118, 119, 121, 122, 123, 124, 125, 126, 127, 128, 129, 130, 131, 132, 133, 134, 135, 136, 137, 138, 139, 143, 144, 145, 149, 150, 152, 153, 154, 155, 156, 157, 158, 159, 161, 163, 164, 165, 166, 167, 168, 169, 170, 171, 172, 173, 174, 175, 176, 178, 179, 180, 181, 182, 183, 184, 185, 186, 187, 188, 189, 190, 191, 192, 193, 194, 195, 197, 198, 199, 200, 201, 202, 203, 204, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 238, 239, 240, 241, 242, 243, 244, 245, 246, 247, 248, 249, 250, 251, 252, 253, 254, 255, 256, 257, 258, 260, 261, 262, 263, 264, 265, 266, 267, 268, 269, 270, 271, 272, 273, 274, 275, 276, 278, 279, 280, 282, 283, 284, 285, 286, 287, 288, 289, 290, 291, 292, 293, 294, 295, 296, 297, 298, 299, 300, 301, 302, 303, 304, 305, 306, 307, 308, 310, 311, 312, 313, 314, 315, 316, 317, 318, 319, 320, 321, 322, 323, 324, 325, 326, 327, 331, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 408, 410, 411, 412, 413, 414, 415, 416, 417, 419, 420, 422, 423, 424, 425, 426, 427, 428, 429, 430, 431, 432, 434, 437, 438, 439, 440, 441, 442, 443, 444, or 447 with reference to amino acid positions set forth in SEQ ID NO:3, so long as the resulting modified PH20 polypeptide is inactive and exhibits less than 20%, and generally less than 10%, of the hyaluronidase activity of the corresponding PH20 polypeptide not containing the amino acid replacement. Typically, the amino acid residue that is modified (e.g., replaced) at the position corresponding to any of the above positions in a PH20 polypeptide is an identical residue, a conservative residue or a semi-conservative amino acid residue to the amino acid residue set forth in SEQ ID NO:3.

Exemplary amino acid replacements at any of the above corresponding positions are set forth in Table 5. Reference to corresponding position in Table 5 is with reference to positions set forth in SEQ ID NO:3. It is understood that the replacements can be made in the corresponding position in another PH20 polypeptide by alignment therewith with the sequence set forth in SEQ ID NO:3 (see e.g., FIGS. 1 and 2), whereby the corresponding position is the aligned position. The amino acid replacement(s) can be at the corresponding position in a PH20 polypeptide as set forth in any of SEQ ID NOS: 2, 3, 6-66, 68-72, 856-861, 869 or 870 or a variant thereof having at least 75%, 80%, 81%, 82%, 83%, 84%, 85%, 86%, 86%, 88%, 89%, 90%, 91%, 92%, 93%, 94%, 95%, 96%, 97%, 98%, 99% or more sequence identity thereto, so long as the resulting modified PH20 polypeptide is inactive. For example, the replacement(s) can be in a corresponding position in a human PH20 polypeptide, for example, any set forth in any of SEQ ID NOS: 3, 7, 32-66, 69 or 72, or a variant thereof. In particular, any one or more of the replacements are in SEQ ID NO:3, so long as the resulting modified PH20 polypeptide is inactive and exhibits less than 20%, and generally less than 10%, of the hyaluronidase activity of the PH20 polypeptide set forth in SEQ ID NO:3

TABLE 5

Inactive Mutants

| Corresponding Position | Replacement | Corresponding Position | Replacement | Corresponding Position | Replacement |
|---|---|---|---|---|---|
| 2 | H K W Y | 3 | A G K P T V | 4 | D E F G L P W Y |
| 5 | D G I L M N P Q R T V W Y | 6 | E F T V Y | 7 | C D F G H I K L Q R S T W Y |
| 8 | D E G H N R S W | 9 | C D E G N P | 10 | F I L M Y |
| 11 | A C F I L P T W Y | 12 | G H W | 13 | E G I L M V |
| 14 | A E G H K N P Q W | 15 | E F G K N P Q R S Y | 16 | A C D E F G H K M P R S T Y |
| 17 | D E G H I L N P Q R S T V W Y | 18 | C D F G H I L M P Q S T V Y | 19 | A C F G H I L M P Q R S V W Y |
| 20 | D E F H K L N P R T V Y | 21 | A C D E G H I L M R S T V W | 22 | C E G K P |
| 23 | A F L M N P R S T V | 25 | D E F G H I K L N P R S T V Y | 27 | C |
| 33 | C D H N V Y | 34 | I L N S T V | 35 | A D G P R S |
| 36 | C F V W Y | 37 | C E G N S | 38 | E G K L N Q R T W |

TABLE 5-continued

Inactive Mutants

| Corresponding Position | Replacement | Corresponding Position | Replacement | Corresponding Position | Replacement |
|---|---|---|---|---|---|
| 39 | C D F W | 40 | A D E G K N R S T V | 41 | Q |
| 42 | D E H I K L M P Q R S T V | 43 | A E F G I K L Q R V | 44 | A C F G H I L N Q R S T W Y |
| 45 | A D F G P W | 46 | P W | 47 | V |
| 48 | P | 49 | C D G H P | 50 | V |
| 51 | C F I M P T W Y | 52 | C E F W Y | 53 | A C D E G H L N P Q R S T W Y |
| 54 | D E G P R Y | 55 | A D G H N P Q R T V Y | 56 | A C E G H I K L P R S T V W |
| 57 | A D F G I M P Q R V W | 58 | A | 59 | A E I L M P R T V W Y |
| 60 | A D F G H I L N P Q S T V Y | 61 | A E F G H N P Q R T W Y | 62 | A C D F I K L M P Q R S T V Y |
| 63 | C G P | 64 | A C D E F G H I K L P Q R S T V W | 65 | A C D G H I K N R S T V W Y |
| 66 | A C D E G I K L N P S T V | 67 | D E G P R T W | 68 | A C G I L P V Y |
| 69 | N T | 70 | Q | 71 | P |
| 72 | C F H I P V W | 73 | P | 75 | D G P |
| 76 | A C F G I K L P Q R S T V W | 77 | D E L P Q R T V | 78 | A D I M P T Y |
| 79 | A D F G H K N P S W Y | 80 | A D E F G I K L M N R S T V Y | 81 | A C E G H L N P S V W Y |
| 82 | Y E K | 84 | Y | 85 | A C D E F G H N Q S T |
| 86 | C P | 87 | P | 88 | A C E F G I K L M P R S T V Y |
| 89 | A D E G Q S T W Y | 90 | C G | 91 | D E F G H I L T |
| 92 | E F H K P Q R W Y | 94 | G P | 95 | A C E F G H K L M P Q S V W Y |
| 96 | S V H P R S T W | 98 | P | 99 | C E G I N P V W |
| 100 | C E F G N P R S T W Y | 101 | A C F H I K L M N Q R S T | 102 | P |
| 103 | A E F G H I L Q R T V W Y | 104 | F P W | 105 | C M N |
| 106 | A C D F H L M N P S W Y | 107 | A C H K P Q S V W | 108 | D E F K L M P Q T V Y |
| 109 | C D E L M R T W | 110 | F K L M P W | 111 | H I Q |
| 112 | C E G H L N P S | 113 | R V | 114 | I L P T V |
| 115 | A C D F G H I K L M R S V Y | 116 | A C D E G H I L N P Q S V W | 117 | D G I K N Q R S V W |
| 118 | C D E G P R W Y | 119 | A K I L N P R | 121 | A C E F G H K L M P W Y |
| 122 | A C E F I K Q R S T V | 123 | A C D E H L M P Q R S T V Y | 124 | C D E F N |

TABLE 5-continued

Inactive Mutants

| Corresponding Position | Replacement | Corresponding Position | Replacement | Corresponding Position | Replacement |
|---|---|---|---|---|---|
| 125 | C D G L N W | 126 | F H I L N P Y | 127 | K |
| 128 | E P | 129 | A C D E G H L P Q S T V W | 130 | C D G H L N S T W Y |
| 131 | P | 132 | P | 133 | D E F G H L M N P R T V W |
| 134 | A C D F G H K P Q R S W | 135 | P | 136 | P |
| 137 | F G H N P R W Y | 138 | V | 139 | P |
| 143 | C H P R S T | 144 | A E F I K P Q S V Y | 145 | T W |
| 149 | E | 149 | P | 150 | V |
| 152 | L | 153 | E F M P R T V | 154 | D E G P S W Y |
| 155 | P Y | 156 | P | 157 | A C D E G H I K L M P Q R S T V |
| 158 | D K P R Y | 159 | W Y | 161 | W |
| 163 | C P | 164 | A C D E G H N P Q R | 165 | C H P T |
| 166 | D | 167 | V | 168 | A C D E F G K L P R S V W Y |
| 169 | A D F G H K N P Q S T Y | 170 | C D E G M P W Y | 171 | C D H M N R S W Y |
| 172 | D E I L P Q T V W Y | 173 | D E G H I L M P S V W Y | 174 | P |
| 175 | C D G K P R S | 176 | A C E F G H I P Q S T V W | 177 | A C D F G H L M Q R S T V W |
| 178 | E I L V W | 180 | A C E P R S | 181 | A C D E F H I K L R S |
| 182 | A C D E H N P Q R S T V Y | 183 | C D E G I K N P Q R S V | 184 | A C D E F G H K L M P R S V |
| 185 | A D E F G I K P R S T V W Y | 186 | A D G H I K L N P Q R S V W | 187 | A F G H I L M N Q R S T V W Y |
| 188 | A C F G H L M N P Q R S T V W | 189 | A E G H K L M N P R S T V W Y | 190 | C E F G H K L N Q R S T V W |
| 191 | A E F G K L M P Q R S T V W Y | 192 | C F G K L M N P Q R V W Y | 193 | A D K L M P V |
| 194 | A C I L P S T V | 195 | S | 197 | C |
| 198 | V W | 199 | E G H I K L P R S W | 200 | A F G H K L M P Q R S W Y |
| 201 | A F L M N P R S T V W | 202 | A E F G H K N P Q R V W Y | 203 | A D E G H L M N Q R S T V |
| 204 | A C E G H I K Q R S T | 206 | C D F G P Y | 207 | A F G M P Q R S T V W |
| 208 | D G P W | 209 | C P | 210 | A C D E G K M N P S T V W Y |
| 211 | C F G H I K M P R S T V W | 212 | A G H I K L M P V W | 213 | P S |

TABLE 5-continued

Inactive Mutants

| Corresponding Position | Replacement | Corresponding Position | Replacement | Corresponding Position | Replacement |
|---|---|---|---|---|---|
| 214 | A C D E G H K N P R S T Y | 215 | C P | 216 | D E G H I K L M N P Q R T V |
| 217 | A C G H P Q S T V W | 218 | A I K L P S V | 219 | P |
| 220 | G K N P R W | 221 | D E H K P R | 222 | P Y |
| 223 | C D E G H K L P Q R S T V W Y | 224 | A D E F G M P Q R S T W Y | 225 | A D E G H K P Q R T V W |
| 226 | A C D E F G L N Q R S T V W Y | 227 | A F G H I K L M P Q R T V W Y | 228 | A E F G H L M N P R S T W |
| 229 | E F G K L P Q T V W | 230 | A E G H K M N P R S T V W Y | 231 | A C D F G H I K L P Q R S V |
| 232 | C G H K L N P Q V Y | 233 | D I P S T | 234 | A D E G H N P S T V W |
| 235 | F L M R W Y | 236 | C I L N Q T Y | 238 | F G L P V W Y |
| 239 | C F G H I L P R S T V W Y | 240 | E F G N W Y | 241 | A C D E G I P R S T V W |
| 242 | A C D G I L M P R S T V W | 243 | C D F G H L M P Q R S W Y | 244 | A D G I V Y |
| 245 | A C F L P Q R S T V | 246 | A C D E G H I K L M P S T V W | 247 | A C F H N P Q R S T W Y |
| 248 | C D E G I M P T | 249 | A G H I K M Q S Y | 250 | C F G H K L M N P Q R S T V W |
| 251 | D F G H K P S T W | 252 | A D E F G H I K L N P S T Y | 253 | A D E G H L M N Q R S W |
| 254 | C D E G I K L P Q R T V W Y | 255 | C D L P V W | 256 | C D E G I |
| 257 | D | 258 | L P V W | 260 | C P |
| 261 | P | 262 | A D E G H I K Q R S T V W Y | 263 | E F P Q W |
| 264 | D E F G L M R T V W Y | 265 | A D F G H K L M N Q R S | 266 | A C G H M P Q R S T V W |
| 267 | D G H I K N R S W | 268 | A C F G H K L N P Q S T V W | 269 | E K L M N P Q R |
| 270 | A C E F G H I P Y | 271 | A D E H K T W | 272 | H L N P W |
| 273 | A C D G I L P Q S V W | 274 | C E G H N Q W Y | 275 | A F G I K L M Q T V W |
| 276 | F P W | 278 | M P | 279 | A C F G L W Y |
| 280 | D I M N R S T V W | 281 | A D G H I K N P Q R S V W | 282 | F L V W Y |
| 283 | A C D F W | 284 | C D F W | 284 | C I P |
| 285 | K P R T V | 286 | A C D F H K M P T Y | 287 | A C D E G K L N P Q R S |
| 288 | D E F G H I K P R T | 289 | A C E G H L P Q R S Y | 290 | D Q Y |
| 291 | A C D E F M N T W Y | 292 | I L T | 293 | E N |
| 294 | A E G H K L N P Q R S T W | 295 | C G H I L N P T V Y | 296 | C F G I K M Q R S T V W Y |

TABLE 5-continued

Inactive Mutants

| Corresponding Position | Replacement | Corresponding Position | Replacement | Corresponding Position | Replacement |
|---|---|---|---|---|---|
| 297 | C E H L N P Q R S T Y | 298 | C E L M N P Q S T W Y | 299 | A C D F G H L M P Q T |
| 300 | A C D E F L M N P Q S T V W | 301 | E G H K M N P Q R S W Y | 302 | C D E F G H L M P R S T Y |
| 303 | A C D E F G K L M R W Y | 304 | A C D G I M N P Q S T V Y | 305 | L P Q R S T V Y |
| 306 | A C H I L V W Y | 307 | C I P | 308 | C F L M V W Y |
| 310 | C E F K L | 311 | C E F I L P V W | 312 | C E M V W |
| 313 | C | 314 | C L W | 315 | C I V |
| 316 | E G I K L M P R S T V W Y | 317 | G P | 318 | C P W |
| 319 | C E F G H I K M P Q R S V W Y | 320 | C P V | 321 | E M P |
| 322 | C D E G I L N P R S T V W | 323 | A C E G H K N R S T V | 324 | C F P V W Y |
| 325 | C R E G H N W | 327 | A E F G H N Q R S T V W Y | 329 | C F G H I K L N Q R S T V W Y |
| 330 | A C D E G I L M N P R S V W | 331 | A C D E F H K Q R S T W Y | 332 | A C D E F G H K L N P R S T Y |
| 333 | G H I K P R S T W Y | 334 | A C D E G M N R S | 335 | F G H I K L P V W Y |
| 336 | A E F G K N P R S T V W Y | 337 | C F G I K L M R T W | 338 | C D E F G H I K L P R T V |
| 339 | D E F G H L N P S T V W Y | 340 | A C D E F G H K P R S T V W | 341 | A E G H K L M N Q R S T V Y |
| 342 | D E F H K L M P Q R T Y | 343 | C D F I P W | 344 | F G H L M N P Q R S T W Y |
| 345 | A C E H K N Q R T V Y | 346 | A D F G I K L M P R S T V W | 347 | C F I P T V W |
| 348 | C H I L P Q R T V W Y | 349 | D F G P V W Y | 350 | A D E F H K L M N P R S T V Y |
| 351 | C D E F H N R W Y | 352 | A D E F G K M P Q R S T V W Y | 353 | C F G H K L M Q R S W |
| 354 | C D E G H I K L M P Q S V W Y | 355 | D F G H L M N P Q R S T V W Y | 356 | C G K L P R T V W |
| 357 | D E F G L M Q R | 358 | E H I K P Q R W | 359 | A F G L P W |
| 360 | A C E F G I K L M P Q R V | 361 | A C E G M N P Q R S V W | 362 | A C E G H K L M N P R S T V W |
| 363 | A C D E F G H I P Q R S T V W | 364 | A C D E F G K L M P R S T V Y | 365 | A C D E G M N P Q R S T W Y |
| 366 | A C E F G K M P Q R T W | 367 | E F I L M Q V | 368 | C P W |
| 369 | C E F I K L P Q V W | 370 | A D E G H K L N P Q R S V Y | 371 | P |
| 372 | A D E F G H K L N P R S T V W | 373 | C P W | 374 | D E |
| 375 | C F P V Y | 376 | I P W | 377 | C I L V |

TABLE 5-continued

Inactive Mutants

| Corresponding Position | Replacement | Corresponding Position | Replacement | Corresponding Position | Replacement |
|---|---|---|---|---|---|
| 378 | D E F I L M Q T W Y | 379 | A C E F I L M W | 380 | C D E G Q R S |
| 381 | G L P W Y | 382 | E G H K L M N P Q R S T W Y | 383 | G P |
| 384 | C F M Q S T | 385 | C L M P W Y | 386 | A C F G H I L M N Q R S T V Y |
| 387 | C E F G H I L M N V W Y | 388 | C G P Q | 389 | F V |
| 390 | A C E F G H L N P R S T V W Y | 391 | A D G H K N P Q R S T V W Y | 392 | C P |
| 393 | C P | 394 | A D E G I K N P Q R S T V | 395 | C ; , [ |
| 396 | C F G I P Y | 397 | A C E F G I L M P Q T V | 398 | A C E G H I L N P R S T V W Y |
| 399 | D P | 400 | A D E F G I L MP Q R S T V Y | 401 | C F H K R W Y |
| 402 | A D E F L M P Q R S T V W Y | 403 | A C E G H K L M N P Q R T | 404 | C D F G H L M N R V W Y |
| 405 | C I V | 406 | P R | 408 | A E F G I K L P R S T V W Y |
| 410 | W | 411 | D E F G | 412 | E H |
| 413 | H I K LP | 414 | A D E G H K R S T | 415 | C D E P |
| 416 | C S | 417 | A D E F G H K M P Q R | 419 | D P |
| 420 | A D F G H K L N R S T W Y | 422 | C D G H L M N Q R S Y | 423 | A D E F G H L M P Q R S T V W |
| 424 | A C E G H N Q R S W Y | 425 | E L P W Y | 426 | C F M R |
| 427 | A C F L P V W Y | 428 | A C D E G H N R S Y | 429 | A D K L N P S T V W Y |
| 430 | A D E L M N S T V | 431 | P | 432 | C F I K L M P Y |
| 434 | H K P Q R W | 437 | T | 438 | Y |
| 439 | N R | 440 | Q | 441 | R |
| 442 | M N S | 443 | D | | |

3. Additional Modifications and Conjugates

The modified PH20 polypeptides include those that contain chemical or posttranslational modifications. In some examples, modified PH20 polypeptides provided herein do not contain chemical or posttranslational modifications. Chemical and post-translational modifications include, but are not limited to, PEGylation, sialation, albumination, glycosylation, farnysylation, carboxylation, hydroxylation, phosphorylation, and other polypeptide modifications known in the art.

Also, in addition to any one or more amino acid modifications, such as amino acid replacements, provided herein, modified PH20 polypeptides provided herein can be conjugated or fused to any moiety using any method known in the art, including chemical and recombinant methods, provided the resulting polypeptide retains hyaluronidase activity. For example, in addition to any one or more amino acid modifications, such as amino acid replacements, provided herein, modified PH20 polypeptides provided herein also can contain other modifications that are or are not in the primary sequence of the polypeptide, including, but not limited to, modification with a carbohydrate moiety, a polyethylene glycol (PEG) moiety, a sialic acid moiety, an Fc domain from immunoglobulin G, or any other domain or moiety. For example, such additional modifications can be made to increase the stability or serum half-life of the protein.

In some instances, the domain or other moiety is a targeted agent, including any agent that targets the conjugate to one or more cell types by selectively binding to a cell surface receptor or other cell surface moiety. For example, the domain or other moiety is a targeted agent that targets the conjugate to tumor cells. In such examples, a modified PH20 polypeptide, such as any provided herein, is linked directly or indirectly to a targeted agent. Such targeting agents include, but are not limited to, growth factors, cytokines, chemokines, antibodies, and hormones, or allelic variants, muteins, or fragments thereof so long as the targeting agent is internalized by a cell surface receptor. Exemplary, non-limiting, additional modifications are described below.

a. Decreased Immunogenicity

The modified PH20 polypeptides provided herein can be made to have decreased immunogenicity. Decreased immunogenicity can be effected by sequence changes that eliminate antigenic epitopes from the polypeptide or by altering post-translational modifications. One of skill in the art is familiar with methods of identifying antigenic epitopes in a polypeptide (see e.g., Liang et al. (2009) BMC Bioinformatics, 10:302; Yang et al. (2009) Rev. Med. Virol., 19:77-96). In some examples, one or more amino acids can be modified in order to remove or alter an antigenic epitope.

In another example, altering the glycosylation of a protein also can effect immunogenicity. For example, altering the glycosylation of the peptide is contemplated, so long as the polypeptides minimally contain at least N-acetylglucosamine at amino acid residues corresponding to amino acid residues set forth as N200, N333 and N358 of SEQ ID NO:3 or 7.

For example, the PH20 polypeptides can be modified such that they lack fucose, particularly bifucosylation. In particular, the PH20 polypeptides provided herein are not bifucosylated. This can be achieved by expressing and producing the PH20 polypeptide in host cells that do not effect bifucosylation. Fucose is a deoxyhexose that is present in a wide variety of organisms, including mammals, insects and plants. Fucosylated glycans are synthesized by fucosyltransferases; see, e.g., Ma et al., Glycobiology, 16(12):158R-184R, (2006); Nakayama et al., J. Biol. Chem., 276:16100-16106 (2001); and Sturla et al., Glycobiology, 15(10):924-935 (2005). In humans, fucose frequently exists as a terminal modification to glycan structures, and the presence of fucose α1,6-linked to N-acetylglucosamine has been shown to be important in glycoprotein processing and recognition. In insects, N-glycan core structures exhibit bifucosylation with α1,6- and α1,3-linkages. Insect cell core fucosylation with α1,3-linkages generates a carbohydrate epitope that is immunogenic in humans (see, e.g., US Publication No. 20070067855). For example, PH20 polypeptides provided herein can be generated in host cells that are incapable of bifucosylating the polypeptide. Thus, while insect cells or other cells that bifucosylate can be used for expression of the polypeptides, typically mammalian cells, such as CHO cells, are used.

In some examples, defucosylated, or fucose-deficient PH20 polypeptides can be generated in insect cells with modified glycosylation pathways, through the use of baculovirus expression vectors containing eukaryotic oligosaccharide processing genes, thereby creating "mammalianized" insect cell expression systems (see, e.g., U.S. Pat. No. 6,461,863). Alternatively, antigenicity can be eliminated by expression of PH20 polypeptides in insect cells lacking α1,3-fucosylatransferase (FT3) (see, e.g., US Publication No. 20070067855). In other examples, defucosylated or fucose-deficient PH20 polypeptides can be generated, for example, in cell lines that produce defucosylated proteins, including Led 3 CHO cells deficient in protein fucosylation (Ripka et al. Arch. Biochem. Biophys. 249:533-545 (1986); U.S. Pat. Pub. No. 2003/0157108; and WO 2004/056312), and knockout cell lines, such as alpha-1,6-fucosyltransferase gene, FUT8, knockout CHO cells (Yamane-Ohnuki et al. Biotech. Bioeng. 87:614 (2004)).

b. Conjugation to Polymers

In some examples, the modified PH20 polypeptides provided herein are conjugated to polymers. Exemplary polymers that can be conjugated to the PH20 polypeptides, include natural and synthetic homopolymers, such as polyols (i.e., poly-OH), polyamines (i.e., poly-$NH_2$) and polycarboxylic acids (i.e., poly-COOH), and further heteropolymers, i.e., polymers containing one or more different coupling groups, e.g., hydroxyl groups and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG), branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose, carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which have few reactive groups capable of cross-linking. Typically, the polymers are non-toxic polymeric molecules such as (methoxy)polyethylene glycol (mPEG) which can be covalently conjugated to the PH20 polypeptides (e.g., to attachment groups on the protein surface) using a relatively simple chemistry.

Suitable polymeric molecules for attachment to the PH20 polypeptides include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g., Roberts et al., Advanced Drug Delivery Review 2002, 54:459-476; Harris and Zalipsky (eds.) "Poly (ethylene glycol), Chemistry and Biological Applications" ACS Symposium Series 680, 1997; Mehvar et al., J. Pharm. Pharmaceut. Sci., 3(1):125-136, 2000; Harris and Chess (2003) Nat Rev Drug Discov. 2(3):214-21; and Tsubery, J Biol. Chem 279(37):38118-24, 2004). The polymeric molecule can be of a molecular weight typically ranging from about 3 kDa to about 60 kDa. In some embodiments the polymeric molecule that is conjugated to a PH20 polypeptide provided herein has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e., "PEGylation") are known in the art (see e.g., U.S. 2006/0104968; U.S. Pat. No. 5,672,662; U.S. Pat. No. 6,737,505; and U.S. 2004/0235734). Techniques for PEGylation include, but are not limited to, specialized linkers and coupling chemistries (see e.g., Roberts, Adv. Drug Deliv. Rev. 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002) (see, also, for example, Lu and Felix (1994) *Int. J. Peptide Protein Res.* 43:127-138; Lu and Felix (1993) *Peptide Res.* 6:140-6, 1993; Felix et al. (1995) *Int. J. Peptide Res.* 46:253-64; Benhar et al. (1994) *J. Biol. Chem.* 269:13398-404; Brumeanu et al. (1995) *J Immunol.* 154:3088-95; see also, Caliceti et al. (2003) *Adv. DrugDeliv. Rev.* 55(10): 1261-77 and Molineux (2003) *Pharmacotherapy* 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/0114037; U.S. 2005/0171328; U.S. 2005/0209416; EP 1064951; EP 0822199; WO 01076640; WO 0002017; WO 0249673; WO 9428024; WO 0187925; and WO 2005000360).

D. Methods for Identifying Modified Hyaluronan-Degrading Enzymes with Altered Properties or Activities Provided herein are methods for identifying a modified or variant hyaluronan-degrading enzyme, such as a modified hyaluronidase or modified PH20 polypeptide, that exhibits an altered activity or property compared to an unmodified hyaluronan-degrading enzyme. In particular, the methods provided herein can be used to screen for one or more modified hyaluronan-degrading enzymes, such as one or more modified hyaluronidase or PH20 polypeptide, that exhibits increased activity and/or increased stability in the presence of a denaturation agent or condition. For example, the methods can be used to identify a modified or variant hyaluronan-degrading enzyme, such as a modified or variant hyaluronidase or modified or variant PH20 polypeptide, that exhibits increased stability by virtue of increased resistance to denaturation conditions, including but not limited to, denaturation conditions caused by temperature (e.g., elevated temperature such as heat), agitation, no or low salt, presence of an excipient and/or a denaturing agent. Exemplary denaturing agents or excipients include, but are not limited to, antiadherents, binders, coatings, fillers and diluents, flavors, colors, lubricants, glidants, preservatives, sorbents or sweeteners. For example, various excipients, such as preservatives, can act as protein denaturing agents. In the method, the activity also can be compared to an unmodified hyaluronan-degrading enzyme under the same denaturation condition, and a modified hyaluronan-degrading enzyme identified or selected that exhibits greater activity than the corresponding unmodified hyaluronan-degrading enzyme.

In the method, one or more modified hyaluronan-degrading enzymes are provided. In some examples, a library of modified molecules is prepared. Methods of mutagenesis and generation of libraries or collections of variant molecules is described herein and is known to one of skill in the art using standard recombinant DNA techniques. In one example, the enzymes that are tested can be pooled and screened, whereby the method permits selection of only those enzymes that exhibit a desired activity. In another example, the tested enzymes can be physically separated and screened individually, such as by formatting in arrays, such as addressable arrays.

In one aspect of the method, the modified hyaluronan-degrading enzymes are tested or screened for hyaluronidase activity in the presence and absence of one or more denaturation conditions or denaturing agent. After testing under both sets of conditions, the activities are assessed in order to identify modified hyaluronan-degrading enzymes that exhibit activity in the presence of the denaturation condition. The desired level or amount of activity selected as a cut-off in the methods can be empirically determined by the user, and is dependent on factors such as the particular hyaluronan-degrading enzyme, the desired application or use of the hyaluronan-degrading enzyme, the particular denaturation condition or denaturing agent and other similar factors. Typically, a modified hyaluronan-degrading enzyme is identified that exhibits at least 5% or 10% of the activity in the presence of a denaturing agent or condition compared to in its absence, and generally at least 15%, 20%, 30%, 40%, 50%, 60%, 70%, 80%, 90%, 95% or more, for example at least 40% of the activity.

Additionally or alternatively, the activity of the modified hyaluronan-degrading enzyme in the presence of one or more denaturation conditions or denaturing agents is compared to the activity of the corresponding unmodified hyaluronan-degrading enzyme in the presence of the same denaturation agent(s) or condition(s). In such examples, it is understood that the activity of the modified and unmodified enzyme are tested under the same conditions (e.g., time, temperature, composition), except for the difference in the particular enzyme tested (unmodified versus modified). A modified hyaluronan-degrading enzyme is identified that exhibits greater activity, such as at least 110%, 120%, 130%, 140%, 150%, 160%, 170%, 180%, 190%, 200%, 250%, 300%, 400%, 500% or more of the activity of the unmodified hyaluronan-degrading enzyme.

The method can be performed a plurality of times, whereby the steps of the method are repeated 1, 2, 3, 4, or 5 times. The method provided herein also is iterative. In one example, after the method is performed, any identified modified hyaluronan-degrading enzyme can be modified or further modified to increase or optimize the activity.

A description of the steps of the method and components of the method are provided in the subsections that follow.

1. Hyaluronan-Degrading Enzymes and Libraries of Modified Hyaluronan-Degrading Enzymes In the methods herein, one or more modified hyaluronan-degrading enzymes, such as a hyaluronidase or a PH20 polypeptide, are tested for a desired activity or property, such as increased stability (e.g., increased resistance to a denaturation condition). The modified hyaluronan-degrading enzyme can be modified compared to an unmodified hyaluronan-degrading enzyme, such as any hyaluronan-degrading enzyme known in the art. Hyaluronan-degrading enzymes are a family of enzymes that degrade hyaluronic acid, which is an essential component of the extracellular matrix and a major constituent of the interstitial barrier. Hyaluronan-degrading enzymes act to degrade hyaluronan by cleaving hyaluronan polymers, which are composed of repeating disaccharides units: D-glucuronic acid (GlcA) and N-acetyl-D-glucosamine (GlcNAc), linked together via alternating $\beta 1 \rightarrow 4$ and $\beta$-$1 \rightarrow 3$ glycosidic bonds. By catalyzing the hydrolysis of hyaluronic acid, a major constituent of the interstitial barrier, hyaluronan-degrading enzymes lower the viscosity of hyaluronic acid, thereby increasing tissue permeability. Accordingly, hyaluronan-degrading enzymes for the uses and methods provided herein include any enzyme having the ability to catalyze the cleavage of a hyaluronan disaccharide chain or polymer. In some examples, the hyaluronan-degrading enzyme cleaves the $\beta$-$1 \rightarrow 4$ glycosidic bond in the hyaluronan chain or polymer. In other examples, the hyaluronan-degrading enzyme catalyzes the cleavage of the $\beta$-$1 \rightarrow 3$ glycosidic bond in the hyaluronan chain or polymer.

Hyaluronan-degrading enzymes include enzymes that are membrane-bound or that are soluble forms that are secreted from cells. Thus, where hyaluronan-degrading enzymes include a glycosylphosphatidylinositol (GPI) anchor signal sequence and/or are otherwise membrane-anchored or insoluble, such hyaluronan-degrading enzymes can be provided in soluble form by C-terminal truncation or deletion of all or a portion of the GPI anchor signal sequence to render the enzyme secreted and soluble. Thus, hyaluronan-degrading enzymes include C-terminally truncated variants, e.g., truncated to remove all or a portion of a GPI anchor signal sequence. Examples of such soluble hyaluronidases are soluble PH20 hyaluronides, such as any set forth in U.S. Pat. No. 7,767,429; U.S. Publication Nos. US 2004/0268425 and US 2010/0143457.

Exemplary hyaluronan-degrading enzymes are non-human animal or human hyaluronidases, bacterial hyaluronidases, hyaluronidases from leeches or chondroitinases that exhibit hyaluronan-degrading activity, including soluble or truncated forms thereof that are active. Exemplary non-human animal hyaluronidases are any set forth in any of SEQ ID NOS: 8-31, 856-861, 869, 870, 871-886, or mature, C-terminally truncated variants that are soluble and active, or active forms thereof. Exemplary human hyaluronidases are any set forth in any of SEQ ID NOS: 2, 3, 6, 7, 32-66, 68-72 or 887-890, or mature, C-terminally truncated variants that are soluble and active, or active forms thereof, and in particular any of SEQ ID NOS: 3, 7, 32-66, 69 or 72. Exemplary bacterial hyaluronidases are any set forth in any of SEQ ID NOS: 891-919 or mature, C-terminally truncated variants that are soluble and active, or active forms thereof. Exemplary hyaluronidases from leeches are set forth in SEQ ID NO:920 or 921, or mature, C-terminally truncated variants that are soluble and active, or active forms thereof. Exemplary chondroitinases that have hyaluronan-degrading enzyme activity are set forth in SEQ ID NO:922-924, or mature, C-terminally truncated variants that are soluble and active, or active forms thereof.

For example, one or more modified PH20 polypeptides are tested for a desired activity or property, such as increased stability (e.g., increased resistance to a denaturation condition). The modified PH20 polypeptide can be modified compared to an unmodified PH20 polypeptide, such as any known PH20 polypeptide native, wildtype or reference polypeptide. For example, the modified PH20 polypeptide is modified compared to a full-length, soluble or active form of a PH20 polypeptide, such as any set forth in any of SEQ ID NOS: 3, 7, 32-66, 69 or 72, or a polypeptide that exhibits at least 85%, such as at least 86%, 87%, 88%, 89%, 90%, 91%, 92%, 93%, 94%, 95%, 96%, 97%, 98%, 99% or more sequence identity to any of SEQ ID NOS: 3, 7, 32-66, 69 or 72. In particular examples of the method herein, the starting or unmodified PH20 polypeptide has the sequence of amino acids set forth in SEQ ID NO:3.

Libraries or collections of modified hyaluronan-degrading enzymes can be screened. Hyaluronan-degrading enzymes can be modified by any process known to one of skill in the art that can alter the structure of a protein. Examples of modifications include replacement, addition, and deletion of one or more amino acids of the protein to form libraries or collections of modified hyaluronan-degrading enzymes. It is within the level of one of skill in the art to generate modified or variant proteins for use in the methods herein. Methods of mutagenesis are well known in the art and include, for example, site-directed mutagenesis such as for example QuikChange (Stratagene) or saturation mutagenesis. Mutagenesis methods include, but are not limited to, site-mediated mutagenesis, PCR mutagenesis, cassette mutagenesis, site-directed mutagenesis, random point mutagenesis, mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient host strains, restriction-selection and restriction-purification, deletion mutagenesis, mutagenesis by total gene synthesis, double-strand break repair, and many others known to persons of skill. In the methods herein, mutagenesis can be effected across the full length of a protein or within a region of a protein. The mutations can be made rationally or randomly.

In some examples, the methods provided herein are performed such that the identity of each mutant protein is known a priori before the protein is tested. For example, the methods provided herein can be conducive to mutagenesis and screening or testing methods that are addressable. This can permit the ease of comparisons between the activities of tested proteins without the need for sequencing of identified proteins. For example, site-directed mutagenesis methods can be used to individually generate mutant proteins. Mutagenesis can be performed by the replacement of single amino acid residues at specific target positions one-by-one, such that each individual mutant generated is the single product of each single mutagenesis reaction. Mutant DNA molecules can be designed, generated by mutagenesis and cloned individually, such as in addressable arrays, such that they are physically separated from each other and each one is the single product of an independent mutagenesis reaction. The amino acids selected to replace the target positions on the particular protein being optimized can be either all of the remaining 19 amino acids, or a more restricted group containing only selected amino acids. In some methods provided herein, each amino acid that is replaced is independently replaced by 19 of the remaining amino acids or by less than 19 of the remaining amino acids, such as 10, 11, 12, 13, 14, 15, 16, 17 or 18 of the remaining amino acids.

2. Screening or Testing for a Desired Activity or Property

The hyaluronidase activity or other activity of a composition containing a modified hyaluronan-degrading enzyme is screened or tested under conditions that expose the hyaluronan-degrading enzyme to a denaturation condition or a denaturing agent (presence of denaturation condition or denaturing agent). The denaturing condition or denaturing agent need not be a condition or agent that is completely deadly to the enzyme, but generally is any condition or agent that destabilizes enzyme activity over time. For example, the denaturation condition can be a condition caused by temperature (e.g., elevated temperature such as greater than or about or 30° C., for example, 30° C. to 42° C. such as or about 37° C.), agitation, no or low salt (e.g., NaCl), and/or caused by the presence of a denaturing agent, such as the presence of excipients (e.g., presence of preservatives).

For purposes of selecting or identifying a modified hyaluronan-degrading enzyme that exhibits stability or increased stability under the denaturation condition, activity can be compared to activity of the modified hyaluronan-degrading enzyme in the absence of the denaturation condition and/or activity of the corresponding unmodified hyaluronan-degrading enzyme in the presence of the denaturation condition. For example, the modified hyaluronan-degrading enzyme also can be screened or tested under the same conditions, except not including a denaturing condition or denaturing agent (absence of denaturation condition or denaturing agent). If desired, the activity of the corresponding unmodified hyaluronan-degrading enzyme (e.g., the hyaluronan-degrading enzyme not containing the amino acid replacements)) can also be tested under the same conditions that expose the hyaluronan-degrading enzyme to the same denaturation condition or a denaturing agent.

For example, each member of a library or collection of modified hyaluronan-degrading enzymes is incubated under or exposed to one or more denaturation conditions. The incubation or exposure can occur in vivo or in vitro. Typically, the assay is performed in vitro. The same modified enzyme also is exposed or incubated to a reference or control condition that does not contain the denaturation condition. The activities under both conditions are compared in order to identify modified hyaluronan-degrading enzymes that exhibit stability upon exposure to a denaturation condition or conditions. Further, in screening or identifying the activity of the enzyme under the two different sets of conditions, generally the only conditions that are varied in the assay relate to the presence or absence of one or more denaturation conditions. The other conditions of the assay, including but not limited to, time, temperature and/or other incubation conditions, can be the same for both sets of conditions.

For example, exposure can be achieved by incubation of a modified hyaluronan-degrading enzyme in an assay buffer or composition that has been modified or adjusted to contain a denaturing agent such as an excipient or low or no salt. Exemplary denaturing agents or excipients include, but are not limited to, antiadherents, binders, coatings, fillers and diluents, flavors, colors, lubricants, glidants, preservatives, sorbents or sweeteners. The choice of buffer that is used can be empirically determined by one skilled in the art depending on the particular parameter or parameters being modified. Exemplary assay buffers are Good's buffers (see e.g., Good et al. (1966) Biochemistry, 5:467-477). Examples of such buffers include, but are not limited to ACES, ADA, BES, Bicine, BIS-TRIS, CAPS, HEPES, MES, MOPS, PIPES, TRIS or Trizma® buffers. Further, the amount or concentration of the excipient or salt can be empirically determined by one of skill in the art depending on the choice of excipient or salt and the desired level or activity of the modified hyaluronan-degrading enzyme.

In one example, the assay buffer or composition is modified by inclusion of an amount of a denaturing agent or denaturing excipient that is a preservative, for example; a phenolic preservative. The phenolic preservative can be phenol, metacresol (m-cresol), benzyl alcohol, and parabens including methylparaben and propylparaben. In particular, the phenolic preservative is phenol and/or m-cresol. The total amount of one or more phenolic preservative agents as a percentage (%) of mass concentration (w/v) can be between 0.05% to 0.6%, 0.1% to 0.4%, 0.1% to 0.3%, 0.15% to 0.325%, 0.15% to 0.25%, 0.1% to 0.2%, 0.2% to 0.3% or 0.3% to 0.4% inclusive. In such an example, the activity of the modified hyaluronan-degrading enzyme is tested or assessed in the presence of such a total amount (e.g., between or about between 0.05% to 0.6%) of one or more preservatives, for example, one or more phenolic preservatives. In some examples, the modified hyaluronan-degrading enzyme also can be tested or assessed under a control or reference condition in which the assay buffer or composition is not modified to contain a preservative. In certain instances, as a control, the activity of modified hyaluronan-degrading enzymes also can be compared to the corresponding unmodified hyaluronan-degrading enzyme not containing the modification(s) under conditions that contain a preservative agent and/or under conditions that do not contain a preservative agent.

In another example, the assay buffer is modified by the presence of a denaturation condition that is low or no salt. As discussed elsewhere herein, hyaluronan-degrading enzymes, such as PH20, generally require salt (e.g., NaCl, Lys-Lys or $MgCl_2$) for activity. Hence, the absence of salt or low salt is denaturing to the enzyme. In one example, the assay buffer is modified by inclusion of an amount of salt that is less than 100 mM, for example, less than 90 mM, 80 mM, 70 mM, 60 mM, 50 mM, 40 mM, 30 mM, 25 mM, 20 mM, 15 mM, 10 mM, 5 mM or less. In such an example, the activity of the modified hyaluronan-degrading enzyme is tested in the absence of salt or in the presence of salt that is less than 100 mM. In some examples, the modified hyaluronan-degrading enzyme also can be tested or assessed under a control or reference condition in which the assay buffer contains a higher salt concentration, generally between or about between 140 mM to 200 mM. In certain instances, as a control, the activity of modified hyaluronan-degrading enzymes also can be compared to the corresponding unmodified hyaluronan-degrading enzyme not containing the modification(s) under conditions that contain low or no salt, such as less than 100 mM and/or under conditions that contain salt in an amount that is between or about between 140 mM to 200 mM.

Exposure of a hyaluronan-degrading enzyme to a denaturation condition also can be achieved by incubation of a modified hyaluronan-degrading enzyme under conditions that are known to be denaturing, such as under conditions of elevated temperature such as a temperature greater than or about or 30° C. (e.g., 30° C. to 42° C. such as or about 37° C.) or agitation. For example, the activity of the modified hyaluronan-degrading enzyme is tested at elevated temperatures greater than or about or 30° C. to 42° C. In some examples, the modified hyaluronan-degrading enzyme also can be tested or assessed under a control or reference condition where the temperatures is less than 30° C., such as between or about between 0° C. to 25° C., for example, 0° C. to 5° C. or 18° C. to 25° C. In certain instances, as a control, the activity of modified hyaluronan-degrading enzymes also can be compared to the corresponding unmodified hyaluronan-degrading enzyme not containing the modification(s) under elevated temperatures greater than or about or 30° C. to 42° C. and/or temperatures is less than 30° C., such as between or about between 0° C. to 25° C., for example, 0° C. to 5° C. or 18° C. to 25° C.

The modified hyaluronan-degrading enzyme can be exposed to one or more than one of the conditions. The exposure to one condition can occur simultaneously, subsequently, intermittently or periodically to exposure to one or more other conditions.

In one example, in the method herein, the modified hyaluronan-degrading enzyme is incubated or exposed to the denaturation condition or denaturing agent prior to performing an assay for hyaluronidase activity. For example, the modified hyaluronan-degrading enzyme is incubated in the presence of a denaturing agent or exposed to one or more denaturation conditions or control conditions, such as one or more of the denaturation conditions or control conditions as described above. The incubation or exposure can be for any desired length of time, and can be empirically determined by one of skill in the art. For example, the modified hyaluronan-degrading enzyme can be incubated or exposed to one or more denaturation conditions, denaturing agents or control conditions for or about for 1 minute to 1 month, such as 1 minute to 3 weeks, 1 minute to 2 weeks, 1 minute to 1 week, 1 minute to 24 hours, 1 minute to 12 hours, such as 30 minutes to 6 hours or 1 hour to 4 hours, and generally at least or about at least 30 minutes, 1 hour, 2 hours, 3 hours, 4 hours, 5 hours, 6 hours, 7 hours, 8 hours, 9 hours, 10 hours, 11 hours or 12 hours. After the time of incubation or exposure, the sample or composition containing the modified hyaluronan-degrading enzyme (or control unmodified enzyme) is assessed for hyaluronidase activity. In another example, the modified hyaluronan-degrading enzyme is exposed or incubated under one or more denaturation conditions and is simultaneously or concurrently assessed for hyaluronidase activity. In any examples where a modified hyaluronan-degrading enzyme is assessed, it is understood that an unmodified hyaluronan-degrading enzyme not containing the modifications(s) also can be assessed under similar assay conditions for comparison.

Assays to assess hyaluronidase activity are well known in the art. Examples of such assays are described in Section G. In one example, hyaluronidase activity can be assessed in a microturbidity assay, wherein the amount of undegraded HA is measured by the addition of a reagent that precipitates HA (e.g., Cetylpyridinium chloride (CPC) or acidified serum) after the enzyme is allowed to react with HA. In another example, hyaluronidase activity can be assessed using a microtiter assay in which residual biotinylated hyaluronic acid is measured following incubation with hyaluronidase (see e.g., Frost and Stern (997) *Anal. Biochem.* 251:263-269, U.S. Pat. Publication No. 20050260186). The resulting activities under each of the tested conditions is determined and compared.

3. Selection or Identification

In the method, after screening modified hyaluronan-degrading enzymes under one or more denaturation conditions, the hyaluronidase activities of the tested enzymes are compared. The method is practiced in order to identify a modified hyaluronan-degrading enzyme that is more resistant to denaturation by a condition or a denaturing agent, whereby the activity of the enzyme is indicative of the stability of the enzyme as a measure of its resistance to denaturation. It is understood that some reduction of enzyme activity, as a result of denaturation, can be tolerated in various applications, and thus the method can be practiced to select for a modified hyaluronan-degrading enzymes that exhibits a requisite activity upon exposure to a denaturation condition to permit its use or application (e.g., therapeutic activity). For example, a modified enzyme can be selected that loses activity more slowly than the corresponding unmodified or reference hyaluronan-degrading enzyme, but whose retained activity is sufficient for a particular application or purpose.

In examples of the methods herein, the activity of the modified hyaluronan degrading enzyme is assessed upon exposure to a first denaturation condition and also assessed upon exposure to a second condition that is a control or non-denaturation condition, and the resulting hyaluronidase activities compared. For comparison, in some examples, the activity can be represented as a ratio of activity or a percentage of activity under a denaturation condition compared to under a control or non-denaturation condition. For example, where the parameter that differs between the first and second condition is the presence of preservative (e.g., phenolic preservative), activity can be represented as a ratio of activity or percentage of activity observed in the presence of preservative (e.g., phenolic preservative) versus activity in the absence of preservative (e.g., phenolic preservative). In another example, where the parameter that differs between the first and second condition is temperature, activity can be represented as a ratio of activity or percentage of activity observed in the presence of elevated temperature (e.g., 30° C. to 42° C.) compared to activity in the presence of a lower temperature such as 0° C. to 25° C., for example 0° C. to 5° C. or 18° C. to 25° C.

A modified hyaluronan-degrading enzyme is selected or identified that retains or exhibits any desired activity in the presence of the denaturation condition compared to in its absence. The particular cut-off of activity for selection of enzymes herein is dependent on the particular user and/or practice of the method and can be empirically determined depending on factors such as the particular denaturation condition or denaturing agent, the particular modified hyaluronan-degrading enzyme, the desired application of the identified or selected hyaluronan-degrading enzyme and other similar factors. Generally, a selected or identified modified hyaluronan-degrading enzyme exhibits stability if any detectable activity is measured or assessed upon exposure or incubation with a denaturation condition or denaturing agent. For example, a selected or identified modified hyaluronan-degrading enzyme exhibits stability, or resistance to a denaturation condition or denaturing agent, if it exhibits at least 5% or 10% of the activity of the same enzyme in the absence of the denaturation condition or denaturing agent, and generally if the modified hyaluronan-degrading enzyme exhibits an activity that is at least 15% of the initial hyaluronidase activity prior to incubation in the presence of the denaturation condition. For example, a modified hyaluronan-degrading enzyme is selected or identified that exhibits at least (or at least about) 16%, 17%, 18%, 19%, 20%, 25%, 30%, 35%, 40%, 45%, 50%, 55%, 60%, 65%, 70%, 75%, 80%, 85%, 90%, 95%, 100%, 110%, 120%, 130%, 140%, 150%, 200%, 300%, 400%, 500% or more of the initial hyaluronidase activity of the modified hyaluronan-degrading enzyme tested under a control or non-denaturation condition.

In other examples of the methods herein, the activity of the modified hyaluronan degrading enzyme is assessed upon exposure to a denaturation condition and the activity of the unmodified or reference hyaluronan-degrading enzyme also is assessed upon exposure to the same denaturation conditions. In such examples, the activities are compared when the enzymes are exposed to the same conditions. For comparison, the activity under a denaturation condition can be represented as a ratio of activity or a percentage of activity of a modified hyaluronan-degrading enzyme compared to an unmodified or reference hyaluronan-degrading enzyme. In such examples, a modified hyaluronan-degrading enzyme is selected that exhibits greater activity under a denaturation condition than the unmodified or reference hyaluronan-degrading enzyme. Thus, the modified hyaluronan-degrading enzyme is one that is more resistant to the condition. For example, where the denaturation condition is the presence of preservative (e.g., phenolic preservative), the activity observed in the presence of preservative (e.g., phenolic preservative) can be represented as a ratio of activity or percentage of activity of the modified hyaluronan-degrading enzyme compared to the unmodified or reference hyaluronan-degrading enzyme. In another example, where the denaturation condition is high temperature, activity observed in the presence of elevated temperature (e.g., 30° C. to 42° C.) can be represented as a ratio of activity or percentage of activity of the modified hyaluronan-degrading enzyme compared to the unmodified or reference hyaluronan-degrading enzyme.

In such examples, a modified hyaluronan-degrading enzyme, such as a modified PH20, is identified or selected that exhibits a ratio of activity that is greater than or at least 1.1, such that the enzyme exhibits greater activity than the unmodified or reference hyaluronan-degrading enzyme under the denaturation condition. For example, the ratio is at least or at least about 1.2, 1.3, 1.4, 1.5, 1.6, 1.7, 1.8, 1.9, 2.0, 2.5, 3.0, 3.5, 4.0, 5.0, 6.0, 7.0, 8.0, 9.0 or greater. A modified hyaluronan-degrading enzyme (e.g., a modified PH20) can be selected if its activity is at least 120%, 130%, 140%, 150%, 160%, 170%, 180%, 190%, 200%, 250%, 300%, 400%, 500% or more of the activity of the unmodified or reference hyaluronan-degrading enzyme when tested under the same conditions. Thus, modified hyaluronan-degrading enzymes are identified that exhibit greater or improved stability compared to the unmodified hyaluronan-degrading enzyme or a reference hyaluronan-degrading enzyme as manifested by increased resistance to a denaturation condition or denaturing agent.

4. Iterative Methods

The method provided herein also is iterative. In one example, after the method is performed, any modified hyaluronan-degrading enzymes identified as exhibiting stability, such as increased stability, under a denaturation condition can be modified or further modified to increase or optimize the stability. A secondary library can be created by introducing additional modifications in a first identified modified hyaluronan-degrading enzyme. For example, modifications that were identified as conferring stability, such as increasing stability, can be combined to generate a combinatorial library. The secondary library can be tested using the assays and methods described herein.

In another example of an iterative aspect of the method, modified hyaluronan-degrading enzymes that are identified as not exhibiting stability such as increased stability (e.g., such that they are not active or do not have increased activity under the a denaturation condition), can be further modified and retested for stability under a denaturation condition. The further modifications can be targeted near particular regions (e.g., particular amino acid residues) associated with activity and/or stability of the molecule. For example, residues that are associated with activity and/or stability of the molecule generally are critical residues that are involved in the structural folding or other activities of the molecule. Hence, such residues are required for activity, generally under any condition. Critical residues can be identified because, when mutated, a normal activity of the protein is ablated or reduced. For example, critical residues can be identified that, when mutated in a hyaluronan-degrading enzyme, exhibit reduced or ablated hyaluronidase activity under a normal or control assay condition. A further library of modified proteins can be generated with amino acid mutations targeted at or near to the identified critical amino acid residues, such as adjacent to the identified critical amino acid residues. In some examples, the mutations can be amino acid replacement to any other of up to 19 other amino acid residues. The secondary library can be tested using the assays and methods described herein.

E. Production of Modified PH20 Polypeptides and Encoding Nucleic Acid Molecules

Polypeptides of a modified PH20 polypeptide set forth herein can be obtained by methods well known in the art for protein purification and recombinant protein expression. Polypeptides also can be synthesized chemically. Modified or variant, including truncated, forms can be engineered from a wildtype polypeptide using standard recombinant DNA methods. For example, modified PH20 polypeptides can be engineered from a wildtype polypeptide, such as by site-directed mutagenesis.

1. Isolation or Preparation of Nucleic Acids Encoding PH20 Polypeptides

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

For example, when the polypeptides are produced by recombinant means, any method known to those of skill in the art for identification of nucleic acids that encode desired genes can be used. Any method available in the art can be used to obtain a full length or partial (i.e., encompassing the entire coding region) cDNA or genomic DNA clone encoding a PH20, such as from a cell or tissue source.

Methods for amplification of nucleic acids can be used to isolate nucleic acid molecules encoding a desired polypeptide, including for example, polymerase chain reaction (PCR) methods. Examples of such methods include use of a Perkin-Elmer Cetus thermal cycler and Taq polymerase (Gene Amp). A nucleic acid containing material can be used as a starting material from which a desired polypeptide-encoding nucleic acid molecule can be isolated. For example, DNA and mRNA preparations, cell extracts, tissue extracts, fluid samples (e.g., blood, serum, saliva), samples from healthy and/or diseased subjects can be used in amplification methods. The source can be from any eukaryotic species including, but not limited to, vertebrate, mammalian, human, porcine, bovine, feline, avian, equine, canine, and other primate sources. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. If desired, degenerate primers can be used for amplification. Oligonucleotide primers that hybridize to sequences at the 3' and 5' termini of the desired sequence can be uses as primers to amplify by PCR sequences from a nucleic acid sample. Primers can be used to amplify the entire full-length PH20, or a truncated sequence thereof, such as a nucleic acid encoding any of the soluble PH20 polypeptides provided herein. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. For example, exemplary heterologous signal sequences include, but are not limited to, human and mouse kappa IgG heterologous signal sequences set forth in SEQ ID NO: 868. Additional nucleotide residue sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene.

In addition, tags or other moieties can be added, for example, to aid in detection or affinity purification of the polypeptide. For example, additional nucleotide residue sequences such as sequences of bases specifying an epitope tag or other detectable marker also can be linked to enzyme-encoding nucleic acid molecules. Examples of such sequences include nucleic acid sequences encoding a His tag or Flag Tag.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein (see e.g., SEQ ID NOS:4 and 5). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.).

If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing.

Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

In addition to recombinant production, modified PH20 polypeptides provided herein can be produced by direct peptide synthesis using solid-phase techniques (see e.g., Stewart et al. (1969) *Solid-Phase Peptide Synthesis*, WH Freeman Co., San Francisco; Merrifield J (963) *J Am Chem Soc*, 85:2149-2154). In vitro protein synthesis can be performed using manual techniques or by automation. Automated synthesis can be achieved, for example, using Applied Biosystems 431A Peptide Synthesizer (Perkin Elmer, Foster City Calif.) in accordance with the instructions provided by the manufacturer. Various fragments of a polypeptide can be chemically synthesized separately and combined using chemical methods.

2. Generation of Mutant of Modified Nucleic Acid and Encoding Polypeptides

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g., a kit, such as QuikChange available from Stratagene) of encoding nucleic acid molecules, or by solid phase polypeptide synthesis methods.

3. Vectors and Cells

For recombinant expression of one or more of the desired proteins, such as any modified PH20 polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein. Generally, the cell is a cell that is capable of effecting glyosylation of the encoded protein.

Prokaryotic and eukaryotic cells containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

A host cell strain can be chosen for its ability to modulate the expression of the inserted sequences or to process the expressed protein in the desired fashion. Such modifications of the polypeptide include, but are not limited to, acetylation, carboxylation, glycosylation, phosphorylation, lipidation and acylation. Post-translational processing can impact the folding and/or function of the polypeptide. Different host cells, such as, but not limited to, CHO (DG44, DXB11, CHO-K1), HeLa, MCDK, 293 and WI38 have specific cellular machinery and characteristic mechanisms for such post-translational activities and can be chosen to ensure the correct modification and processing of the introduced protein. Generally, the choice of cell is one that is capable of introducing N-linked glycosylation into the expressed polypeptide. Hence, eukaryotic cells containing the vectors are provided. Exemplary eukaryotic cells are mammalian Chinese Hamster Ovary (CHO) cells. For example, CHO cells deficient in dihydrofolate reductase (e.g., DG44 cells) are used to produce polypeptides provided herein. Note that bacterial expression of an PH20 polypeptide provided herein will not result in a catalytically active polypeptide, but when combined with proper glycosylation machinery, the PH20 can be artificially glycosylated.

Provided are vectors that contain a sequence of nucleotides that encodes the modified PH20 polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein encoding sequence. These include but are not limited to mammalian cell systems infected with virus (e.g., vaccinia virus, adenovirus and other viruses); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include, but are not limited to, the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vector promoters, such as the β-lactamase promoter (Jay et al., (1981) *Proc. Natl. Acad. Sci. USA* 75:5543) or the tac promoter (DeBoer et al., *Proc. Natl. Acad. Sci. USA* 80:21-25 (1983); see also Gilbert and Villa-Komaroff, "Useful Proteins from Recombinant Bacteria," Scientific American 242:74-94 (1980)); plant expression vector promoters, such as the nopaline synthetase promoter (Herrera-Estrella et al., *Nature* 305:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 55:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 375:115-122 (1985)), immunoglobulin gene control region which is active in lymphoid cells (Grosschedl et al., *Cell* 55:647-658 (1984); Adams et al., *Nature* 575:533-538 (1985); Alexander et al., *Mol. Cell. Biol* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 7:268-276 (1987)), alpha-fetoprotein gene control region which is active in liver (Krumlauf et al., *Mol. Cell. Biol.* 5:1639-1648 (1985); Hammer et al., *Science* 255:53-58 1987)), alpha-1 antitrypsin gene control region which is active in liver (Kelsey et al., *Genes and Devel.* 7:161-171 (1987)), beta globin gene control region which is active in myeloid cells (Magram et al., *Nature* 575:338-340 (1985); Kollias et al., *Cell* 46:89-94 (1986)), myelin basic protein gene control region which is active in oligodendrocyte cells of the brain (Readhead et al., *Cell* 45:703-712 (1987)), myosin light chain-2 gene control region which is active in skeletal muscle (Shani, *Nature* 574:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog thereof, one or more origins of replication, and optionally, one or more selectable markers (e.g., an antibiotic resistance gene). Depending on the expression system, specific initiation signals also are required for efficient translation of a PH20 sequence. These signals include the ATG initiation codon and adjacent sequences. In cases where the initiation codon and upstream sequences of PH20 or soluble forms thereof are inserted into the appropriate expression vector, no additional translational control signals are needed. In cases where only a coding sequence, or a portion thereof, is inserted, exogenous transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression can be enhanced by the inclusion of enhancers appropriate to the cell system in use (Scharf et al. (1994) *Results Probl Cell Differ* 20:125-62; Bittner et al. (1987) *Methods in Enzymol*, 153:516-544).

Exemplary plasmid vectors for transformation of *E. coli* cells include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, to and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a H is column and a thrombin cleavage site that permits cleavage following purification over the column, the T7-lac promoter region and the T7 terminator.

Typically, vectors can be plasmids, viral vectors, or others known in the art, used for expression of the modified PH20 polypeptide in vivo or in vitro. For example, the modified PH20 polypeptide is expressed in mammalian cells, including, for example, Chinese Hamster Ovary (CHO) cells. An exemplary vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (ERES) from the ECMV virus (Clontech) and the mouse dihydrofolate reductase (DHFR) gene.

Viral vectors, such as adenovirus, retrovirus or vaccinia virus vectors, can be employed. In some examples, the vector is a defective or attenuated retroviral or other viral vector (see U.S. Pat. No. 4,980,286). For example, a retroviral vector can be used (see Miller et al., Meth. Enzymol. 217: 581-599 (1993)). These retroviral vectors have been modified to delete retroviral sequences that are not necessary for packaging of the viral genome and integration into host cell DNA.

In some examples, viruses armed with a nucleic acid encoding a modified PH20 polypeptide can facilitate their replication and spread within a target tissue for example. The target tissue can be a cancerous tissue whereby the virus is capable of selective replication within the tumor. The virus can also be a non-lytic virus wherein the virus selectively replicates under a tissue specific promoter. As the viruses replicate, the coexpression of the PH20 polypeptide with viral genes will facilitate the spread of the virus in vivo.

4. Expression

Modified PH20 polypeptides can be produced by any method known to those of skill in the art including in vivo and in vitro methods. Desired proteins can be expressed in any organism suitable to produce the required amounts and forms of the proteins, such as for example, those needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Modified PH20 polypeptides also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g., a 6×His or $His_6$ tag or a myc tag, or a tag for purification, for example, a GST fusion, and a sequence for directing protein secretion and/or membrane association.

For long-term, high-yield production of recombinant proteins, stable expression is desired. For example, cell lines that stably express a modified PH20 polypeptide can be transformed using expression vectors that contain viral origins of replication or endogenous expression elements and a selectable marker gene. Following the introduction of the vector, cells can be allowed to grow for 1-2 days in an enriched medium before they are switched to selective media. The purpose of the selectable marker is to confer resistance to selection, and its presence allows growth and recovery of cells that successfully express the introduced sequences. Resistant cells of stably transformed cells can be proliferated using tissue culture techniques appropriate to the cell types.

Any number of selection systems can be used to recover transformed cell lines. These include, but are not limited to, the herpes simplex virus thymidine kinase (Wigler, M et al. (1977) Cell, 11:223-32) and adenine phosphoribosyltransferase (Lowy, I et al. (1980) Cell, 22:817-23) genes, which can be employed in TK− or APRT− cells, respectively. Also, antimetabolite, antibiotic or herbicide resistance can be used as the basis for selection. For example, DHFR, which confers resistance to methotrexate (Wigler, M et al. (1980) Proc. Natl. Acad. Sci, 77:3567-70); npt, which confers resistance to the aminoglycosides neomycin and G-418 (Colbere-Garapin, F et al. (1981) J. Mol. Biol., 150:1-14); and als or pat, which confer resistance to chlorsulfuron and phosphinotricin acetyltransferase, respectively, can be used. Additional selectable genes have been described, for example, trpB, which allows cells to utilize indole in place of typtophan or hisD, which allows cells to utilize histinol in place of histidine (Hartman S C and R C Mulligan (1988) Proc. Natl. Acad. Sci, 85:8047-51). Visible markers, such as but not limited to, anthocyanins, beta glucuronidase and its substrate, GUS, and luciferase and its substrate luciferin, also can be used to identify transformants and also to quantify the amount of transient or stable protein expression attributable to a particular vector system (Rhodes C A et al. (1995) Methods Mol. Biol. 55:121-131).

The presence and expression of PH20 polypeptides can be monitored. For example, detection of a functional polypeptide can be determined by testing the conditioned media for hyaluronidase enzyme activity under appropriate conditions. Exemplary assays to assess the solubility and activity of expressed proteins are provided herein.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters. Such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment, and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach effects protein expression in the periplasmic space of bacteria which provides an oxidizing environment and chaperonin-like and disulfide isomerases, which can aid in the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth 1 also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae*, Schizosaccharomyces pombe, Yarrowia lipolytica, Kluyveromyces lactis and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoters. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects and Insect Cells

Insect cells, particularly using baculovirus expression, are useful for expressing polypeptides such as PH20 polypeptides. Insect cells express high levels of protein and are capable of most of the post-translational modifications used by higher eukaryotes. Baculoviruses have a restrictive host range which improves the safety and reduces regulatory concerns of eukaryotic expression. Typical expression vectors use a promoter for high level expression such as the polyhedrin promoter of baculovirus. Commonly used baculovirus systems include a baculovirus, such as the *Autographa californica* nuclear polyhedrosis virus (AcNPV) or the *bombyx mori* nuclear polyhedrosis virus (BmNPV), and an insect cell line, such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems. Exemplary insect cells are those that have been altered to reduce immunogenicity, including those with "mammalianized" baculovirus expression vectors and those lacking the enzyme FT3.

An alternative expression system in insect cells employs stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Expression

Mammalian expression systems can be used to express proteins including PH20 polypeptides. Expression constructs can be transferred to mammalian cells by viral infection such as by adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 54:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline syntase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

5. Purification

Host cells transformed with a nucleic acid sequence encoding a modified PH20 polypeptide can be cultured under conditions suitable for the expression and recovery of the encoded protein from cell culture. The protein produced by a recombinant cell is generally secreted, but may be contained intracellularly depending on the sequence and/or the vector used. As will be understood by those of skill in the art, expression vectors containing nucleic acid encoding PH20 can be designed with signal sequences that facilitate direct secretion of PH20 through prokaryotic or eukaryotic cell membranes.

Thus, methods for purification of polypeptides from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as modified PH20 polypeptides, can be purified using standard protein purification techniques known in the art including but not limited to, SDS-PAGE, size fractionation and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind PH20 hyaluronidase enzymes can be used in affinity purification. For example, soluble PH20 can be purified from conditioned media.

Expression constructs also can be engineered to add an affinity tag to a protein such as a myc epitope, GST fusion or His$_6$ and affinity purified with myc antibody, glutathione resin or Ni-resin, respectively. Such tags can be joined to the nucleotide sequence encoding a soluble PH20 as described elsewhere herein, which can facilitate purification of soluble proteins. For example, a modified PH20 polypeptide can be expressed as a recombinant protein with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin and the domain utilized in the FLAGS extension/affinity purification system (Immunex Corp., Seattle Wash.). The inclusion of a cleavable linker sequence such as Factor XA or enterokinase (Invitrogen, San Diego, Calif.) between the purification domain and the expressed PH20 polypeptide is useful to facilitate purification. One such expression vector provides for expression of a fusion protein containing a PH20 polypeptide in and an enterokinase cleavage site. The histidine residues facilitate purification on IMAC (immobilized metal ion affinity chromatography), while the enterokinase cleavage site provides a means for purifying the polypeptide from the fusion protein.

Purity can be assessed by any method known in the art including gel electrophoresis, orthogonal HPLC methods, staining and spectrophotometry techniques. The expressed and purified protein can be analyzed using any assay or method known to one of skill in the art, for example, any described in Section G. These include assays based on the physical and/or functional properties of the protein, including, but not limited to, analysis by gel electrophoresis, immunoassay and assays of hyaluronidase activity.

Depending on the expression system and host cells used, the resulting polypeptide can be heterogeneous due to peptidases present in the culture medium upon production and purification. For example, culture of soluble PH20 in CHO cells can result in a mixture of heterogeneous polypeptides.

6. Modification of Polypeptides by PEGylation

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS Symposium Series* 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al, *Macromolecules* 26:581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J.* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, reaction of the polypeptide with N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO05000360; U.S. 2005/0114037; U.S. 2005/0171328; U.S. 2005/0209416; EP 1064951; EP 0822199; WO 01076640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g., the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan-degrading enzyme and reduced in the presence of NaCNBH$_3$. More specifically, PEGylated CMP sugars can be reacted with a hyaluronan-degrading enzyme in the presence of appropriate glycosyl-transferases. One technique is the "PEGylation" technique where a number of polymeric molecules are coupled to the polypeptide in question. When using this technique, the immune system has difficulties in recognizing the epitopes on the polypeptide's surface responsible for the formation of antibodies, thereby reducing the immune response. For polypeptides introduced directly into the circulatory system of the human body to give a particular physiological effect (i.e., pharmaceuticals) the typical potential immune response is an IgG and/or IgM response, while polypeptides which are inhaled through the respiratory system (i.e., industrial polypeptide) potentially can cause an IgE response (i.e., allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced the resulting immune response is.

Typically, to make the PEGylated PH20 polypeptide provided herein, PEG moieties are conjugated, via covalent attachment, to the polypeptides. Techniques for PEGylation include, but are not limited to, specialized linkers and coupling chemistries (see e.g., Roberts, *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

As an exemplary illustrative method for making a PEGylated PH20 polypeptide, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG- reagents available from Dowpharma, a division of Dow Chemical Corporation; including PH20 polypeptides PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 kDa) or another succinimidyl ester of a PEG butanoic acid derivative, to a PH20 polypeptide. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG, as shown in Scheme 1, below.

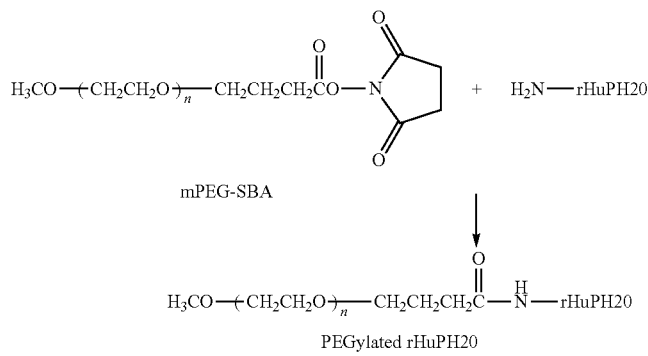

Scheme 1

Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) containing either linear or branched PEGs can be conjugated to PH20. PEGs can used to generate PH20s reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated PH20 (less than 5% non-PEGylated).

Using various PEG reagents, exemplary versions of a PEGylated PH20 polypeptide can be prepared, for example, using mPEG-SBA (30 kD), mPEG-SMB (30 kD), and branched versions based on mPEG2-NHS (40 kD) and mPEG2-NHS (60 kD). PEGylated versions of PH20 can be generated using NHS chemistries, as well as carbonates, and aldehydes, using each of the following reagents: mPEG2-NHS-40K branched, mPEG-NHS-10K branched, mPEG-NHS-20K branched, mPEG2-NHS-60K branched; mPEG-SBA-5K, mPEG-SBA-20K, mPEG-SBA-30K; mPEG-SMB-20K, mPEG-SMB-30K; mPEG-butyrldehyde; mPEG-SPA-20K, mPEG-SPA-30K; and PEG-NHS-5K-biotin. PEGylated PH20 also can be prepared using PEG Typically, the mPEG-SBA-30K or other PEG is added to the PH20 polypeptide at a PEG:polypeptide molar ratio of 10:1 in a suitable buffer, e.g., 130 mM NaCl/10 mM HEPES at pH 6.8 or 70 mM phosphate buffer, pH 7, followed by sterilization, e.g., sterile filtration, and continued conjugation, for example, with stirring, overnight at 4° C. in a cold room. In one example, the conjugated PEG-PH20 is concentrated and buffer-exchanged.

Other methods of coupling succinimidyl esters of PEG butanoic acid derivatives, such as mPEG-SBA-30K are known in the art (see e.g., U.S. Pat. No. 5,672,662; U.S. Pat. No. 6,737,505; and U.S. 2004/0235734). For example, a polypeptide, such as a PH20 polypeptide, can be coupled to an NHS activated PEG derivative by reaction in a borate buffer (0.1 M, pH 8.0) for one hour at 4° C. The resulting PEGylated protein can be purified by ultrafiltration. Another method reacts polypeptide with mPEG-SBA in deionized water to which triethylamine is added to raise the pH to 7.2-9. The resulting mixture is stirred at room temperature for several hours to complete the PEGylation.

Methods for PEGylation of PH20 polypeptides, including, for example, animal-derived hyaluronidases and bacterial hyaluronan-degrading enzymes, are known to one of skill in the art. See, for example, European Patent No. EP 0400472, which describes the PEGylation of bovine testes hyaluorindase and chondroitin ABC lyase. Also, U.S. Publication No. 2006014968 describes PEGylation of a human hyaluronidase derived from human PH20. For example, the PEGylated hyaluronan-degrading enzyme generally contains at least 3 PEG moieties per molecule. In some examples, the PH20 polypeptide contains three to six PEG molecules. In other examples, the enzyme can have a PEG to protein molar ratio between 5:1 and 9:1, for example, 7:1.

F. Pharmaceutical Compositions and Formulations, Dosages and Administration

Pharmaceutical compositions of any of the modified PH20 polypeptides are provided herein for administration. Pharmaceutically acceptable compositions are prepared in view of approvals for a regulatory agency or other agency prepared in accordance with generally recognized pharmacopeia for use in animals and in humans. Typically, the compounds are formulated into pharmaceutical compositions using techniques and procedures well known in the art (see e.g., Ansel *Introduction to Pharmaceutical Dosage Forms*, Fourth Edition, 1985, 126).

In particular, provided herein are pharmaceutical compositions that are stable as a liquid formulation for prolonged periods of time for at least 1 month at temperatures from or from about 2° C. to 8° C., inclusive or for at least 3 days at a temperature from or from about 30° C. to 42° C., inclusive. Pharmaceutical compositions, in particular liquid formulations, can be limited by the stability of the active agent, which can be susceptible to effects of storage conditions (time or length of storage, temperature and/or agitation) and/or, formulation components contained in the composition. Hence, the stable pharmaceutical compositions generally contain a modified PH20 polypeptide as described in Section C.1.b that exhibits increased stability manifested as an increased resistance to one or more protein denaturation conditions. Such protein denaturation conditions can include, but are not limited to, elevated temperature greater than or equal to or about 30° C., agitation, low or no salt, and presence of excipients. The increased stability is characterized by improved storage time, decreased fragmentation, and/or decreased aggregate formation, while still retaining the activity of the active agent(s), e.g., the PH20 hyaluronidase. Such formulations can be provided as "ready-to use" liquid formulations without further reconstitution and/or without any requirement for further dilution. In some examples, the formulations also can be prepared in a lyophilized or concentrated form.

Pharmaceutical compositions containing a modified PH20 polypeptide can be co-administered with another therapeutic agent. In such examples, the modified PH20 polypeptides can be formulated separately as a pharmaceutical composition and administered prior to, simultaneously with, intermittently with, or subsequent to a second composition containing an active therapeutic agent. In other examples, modified PH20 polypeptides can be co-formulated with pharmaceutical formulations of other therapeutic agents.

In particular, provided herein are co-formulations containing a modified PH20 polypeptide as described herein and a therapeutic agent that is a chemotherapeutic agent, an analgesic agent, an anti-inflammatory agent, an antimicrobial agent, an amoebicidal agent, a trichomonacidal agent, an anti-parkinson agent, an anti-malarial agent, an anticonvulsant agent, an anti-depressant agent, and antiarthritics agent, an anti-fungal agent, an antihypertensive agent, an antipyretic agent, an anti-parasite agent, an antihistamine agent, an alpha-adrenergic agonist agent, an alpha blocker agent, an anesthetic agent, a bronchial dilator agent, a biocide agent, a bactericide agent, a bacteriostat agent, a beta adrenergic blocker agent, a calcium channel blocker agent, a cardiovascular drug agent, a contraceptive agent, a decongestant agent, a diuretic agent, a depressant agent, a diagnostic agent, a electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sympathomimetic agent, a tranquilizer agent, an urinary agent, a vaginal agent, a viricide agent, a vitamin agent, a non-steroidal anti-inflammatory agent, an angiotensin converting enzyme inhibitor agent, a polypeptide, a protein, a nucleic acid, a drug, an organic molecule or a sleep inducer. For example, modified PH20 polypeptides provided herein can be co-formulated with an antibody such as a monoclonal antibody, an Immune Globulin, an antibiotic, a bisphosphonate, a cytokine, a chemotherapeutic agent, a coagulation factor or an insulin. Exemplary therapeutic agents that can be co-formulated with a modified PH20 polypeptide are described in described in Section H. In particular, provided herein are co-formulations containing a modified PH20 polypeptide and an insulin, such as a fast-acting insulin, for example, a regular insulin or a fast-acting (rapid-acting) insulin analog. The co-formulations provided herein include stable co-formulations, whereby the active agents, i.e., the modified PH20 polypeptide and the therapeutic agent, exhibit increased stability and retain activity for prolonged periods as described herein.

Formulations containing PH20 provided herein, including separate formulations thereof and co-formulations, are stable for prolonged periods of time, including at varied temperatures and under varied storage or use conditions such as agitation. For example, the formulations provided herein are stable and retain activity of active agent(s) (e.g., PH20 hyaluronidase) at "refrigerator" conditions, for example, at 2° C. to 8° C., such as at or about 4° C., for at least at least 2 months, 3 months, 4 months, 5 months, 6 months, 7 months, at least 8 months, at least 9 months, at least 10 months, at least 11 months, at least 12 months, 13 months, 14 months, 15 months, 16 months, 17 months, 18 months, 19 months, 20 months, 21 months, 22 months, 23 months, 24 months, 25 months, 26 months, 27 months, 28 months, 29 months or 30 months or more. In another example, the formulations provided herein are stable and retain activity of active agent(s) (e.g., PH20 hyaluronidase) at room temperature for example at 18° C. to 32° C., generally 20° C. to 32° C., such as 28° C. to 32° C., for at least 2 weeks to 1 year, for example, at least 3 weeks, 4 weeks, 2 months, 3 months, 4 months, 5 months, 6 months, at least 7 months, at least 8 months, at least 9 months, or at least 1 year or more. In a further example, the formulations provided herein are stable and retain activity of active agent(s) (e.g., PH20 hyaluronidase) at elevated temperatures of about or greater than 30° C., generally from or from about 30° C. to 42° C., such as 32° C. to 37° C. or 35° C. to 37° C. or about or 37° C. for at least 4 days, 5 days, 6 days, 7 days, 8 days, 9 days, 10 days, 11 days, 12 days, 13 days, 14 days, 15 days, 20 days, 21 days, 22 days, 23 days, 24 days, 25 days, 26 days, 27 days, 28 days, 29 days, 30 days, 35 days, 40 days, 45 days, 50 days, 60 days or more.

Compositions can take the form of solutions, suspensions, emulsions, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. Topical formulations also are contemplated. The formulation should suit the mode of administration.

1. Formulations—Liquids, Injectables, Emulsions

The formulation generally is made to suit the route of administration. Parenteral administration, generally characterized by injection or infusion, either subcutaneously, intramuscularly, intravenously or intradermally is contemplated herein. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. Injectables can be prepared in conventional forms, either as liquid solutions or suspensions, solid forms suitable for solution or suspension in liquid prior to injection, or as emulsions. For example, the compositions containing a modified PH20 polypeptide, formulated separately or co-formulated with another therapeutic agent, can be provided as a pharmaceutical preparation in liquid form as a solution, syrup or suspension. In liquid form, the pharmaceutical preparations can be provided as a concentrated preparation to be diluted to a therapeutically effective concentration before use. Generally, the preparations are provided in a dosage form that does not require dilution for use. In another example, pharmaceutical preparations can be presented in lyophilized form for reconstitution with water or other suitable vehicle before use.

Injectables are designed for local and systemic administration. For purposes herein, local administration is desired for direct administration to the affected interstitium. The solutions can be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

The concentration of the pharmaceutically active compound is adjusted so that an injection or infusion provides an effective amount to produce the desired pharmacological effect. The exact dose depends on the age, weight and condition of the patient or animal as is known in the art. The unit-dose parenteral preparations can be packaged in, for example, an ampoule, a cartridge, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art. The percentage of active compound contained in such parenteral compositions is highly dependent on the specific nature thereof, as well as the activity of the compound and the needs of the subject.

Pharmaceutical compositions can include carriers or other excipients. For example, pharmaceutical compositions provided herein can contain any one or more of a diluents(s), adjuvant(s), antiadherent(s), binder(s), coating(s), fillers), flavors), color(s), lubricant(s), glidant(s), preservative(s), detergent(s), sorbent(s) or sweeteners) and a combination thereof or vehicle with which a modified PH20 polypeptide is administered. For example, pharmaceutically acceptable carriers or excipients used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Formulations, including liquid preparations, can be prepared by conventional means with pharmaceutically acceptable additives or excipients.

Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water or oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Suspending and dispersing agents include, but are not limited to, sorbitol syrup, cellulose derivatives or hydrogenated edible fats, sodium carboxymethylcellulose, hydroxypropyl methylcellulose and polyvinylpyrrolidone. Emulsifying agents include, but are not limited to, lecithin or acacia. Detergents include, but are not limited to, Polysorbate 80 (TWEEN 80). Non-aqueous vehicles include, but are not limited to, almond oil, oily esters, or fractionated vegetable oils. Antimicrobial agents or preservatives include, but are not limited to, methyl or propyl-p-hydroxybenzoates or sorbic acid, m-cresol, phenol. A diluent includes, but is not limited to, lactose, sucrose, dicalcium phosphate, or carboxymethylcellulose. A lubricant includes, but is not limited to, magnesium stearate, calcium stearate or talc. A binder includes, but is not limited to, starch, natural gums, such as gum acacia, gelatin, glucose, molasses, polyvinylpyrrolidine, celluloses and derivatives thereof, povidone, crospovidones and other such binders known to those of skill in the art. Isotonic agents include, but are not limited to, sodium chloride and dextrose. Buffers include, but are not limited to, phosphate and citrate. Antioxidants include sodium bisulfate. Local anesthetics include procaine hydrochloride. A sequestering or chelating agent of metal ions includes EDTA. Other suitable pharmaceutical excipients include, but are not limited to, starch, glucose, lactose, dextrose, sucrose, gelatin, malt, rice, flour, chalk, silica gel, sodium stearate, glycerol monostearate, talc, sodium chloride, dried skim milk, glycerol, propylene, glycol, saline, water, and ethanol. Pharmaceutical carriers also include ethyl alcohol, polyethylene glycol and propylene glycol for water miscible vehicles and sodium hydroxide, hydrochloric acid, citric acid or lactic acid for pH adjustment. A composition, if desired, also can contain minor amounts of non-toxic auxiliary substances such as wetting or emulsifying agents, or pH buffering agents, for example, acetate, sodium citrate, cyclodextrin derivatives, sorbitan monolaurate, triethanolamine sodium acetate, triethanolamine oleate, stabilizers, solubility enhancers, and other such agents such as for example, sodium acetate, sodium phosphate, sorbitan monolaurate, triethanolamine oleate and cyclodextrins.

In particular, antimicrobial agents (e.g., preservatives) in bacteriostatic or fungistatic concentrations (e.g., an antimicrobial effective amount) can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride.

The volume of the formulations, including the separately formulated or co-formulated PH20-containing formulations provided herein, can be any volume suitable for the container in which it is provided. In some examples, the formulations are provided in a vial, syringe, pen, reservoir for a pump or a closed loop system, or any other suitable container. For example, the formulations provided herein are between or about between 0.1 mL to 500 mL, such as 0.1 mL to 100 mL, 1 mL to 100 mL, 0.1 mL to 50 mL, such as at least or about at least or about or 0.1 mL, 1 mL, 2 mL, 3 mL, 4 mL, 5 mL, 10 mL, 15 mL, 20 mL, 30 mL, 40 mL, 50 mL or more.

a. Lyophilized Powders

Of interest herein are lyophilized powders, which can be reconstituted for administration as solutions, emulsions and other mixtures. They may also be reconstituted and formulated as solids or gels.

The sterile, lyophilized powder is prepared by dissolving a compound of enzyme in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. A liquid formulation as described herein above can be prepared. The resulting mixture is sterile filtered or treated to remove particulates and to insure sterility, and apportioned into vials for lyophilization. For example, the lyophilized powder can be prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected enzyme is added to the resulting mixture, and stirred until it dissolves.

Each vial is made to contain a single dosage or multiple dosages of the compound. The lyophilized powder can be stored under appropriate conditions, such as at about 4° C. to room temperature. Reconstitution of this lyophilized powder with an appropriate buffer solution provides a formulation for use in parenteral administration, b. Exemplary Formulations Single dose formulations of PH20 are known in the art. For example, Hylenex® recombinant (hyaluronidase human injection) contains, per mL, 8.5 mg NaCl (145 mM), 1.4 mg dibasic sodium phosphate (9.9 mM), 1.0 mg human albumin, 0.9 mg edetate disodium (2.4 mM), 0.3 mg $CaCl_2$ (2.7 mM) and NaOH to adjust the pH to 7.4. Other formulations of human soluble hyaluronidase, such as the rHuPH20 formulations described in U.S. Pat. Pub. No. US2011/0053247, include 130 mM NaCl, 10 mM Hepes, pH 7.0; or 10 mM histidine, 130 mM NaCl, pH 6.0. Any of the modified PH20 polypeptides provided herein can be similarly formulated.

In addition to a therapeutically effective amount of a modified PH20 polypeptide and/or other therapeutic agent, exemplary pharmaceutical compositions provided herein, including separately formulated- and co-formulated-PH20 containing formulations, can contain a concentration of NaCl and are prepared at a requisite pH to maintain the stability of the active agent(s) (e.g., PH20 hyaluronidase and/or other co-formulated therapeutic agent). For multi-dose formulations and other formulations stored for a prolonged time, the compositions generally also contain one or more preservatives. Further stabilizing agents and other excipients also can be included. Exemplary components are described below.

i. Salt (e.g. NaCl)

In examples herein, the pharmaceutical compositions provided herein contain a concentration of salt, such as sodium chloride (NaCl), to maintain the stability of the active agent(s) (e.g., PH20 hyaluronidase). Salt, such as NaCl, is generally required to retain PH20 stability and activity. Low salt concentrations of generally less than 120 mM can have deleterious effects on PH20 activity over time and depending on temperature conditions. Hence, the absence of salt (e.g. NaCl) or a low concentration of salt (e.g. NaCl) can result in instability of the protein. In some examples herein, however, modified PH20 polypeptides that exhibit increased stability in the absence of low or no salt, such as low or no NaCl (see e.g., Section C.1.b.iii), are not susceptible to denaturation. Also, the presence of salt (e.g. NaCl) can have differing effects on other therapeutic agents. For example, the solubility of insulin and insulin analogs tends to increase with lower salt concentration (e.g., <140 mM) and high salt concentrations can result in crystallization/aggregation of insulin, especially at lower temperatures (see e.g., U.S. Provisional Appl. No. 61/520,962; U.S. application Ser. Nos. 13/507,263 and 13/507,262; and International PCT Application No. PCT/US2012/042816). Thus, pharmaceutical compositions provided herein are prepared in accordance with the requirements of the active agent(s). It is within the level of one of skill in the art to assess the stability of the active agent(s) in the formulation and under various storage conditions (see e.g., Section G). In particular examples herein, the pharmaceutical compositions, including the separately formulated or co-formulated PH20-containing formulations provided herein, contain NaCl at a concentration of between or about between 10 mM to 200 mM, such as 10 mM to 50 mM, 50 mM to 200 mM, 50 mM to 120 mM, 50 mM to 100 mM, 50 mM to 90 mM, 120 mM to 160 mM, 130 mM to 150 mM, 80 mM to 140 mM, 80 mM to 120 mM, 80 mM to 100 mM, 80 mM to 160 mM, 100 mM to 140 mM, 120 mM to 120 mM or 140 mM to 180 mM.

ii. pH and Buffer

In examples herein, the pharmaceutical compositions provided herein are prepared at a pH to maintain the stability of the active agent(s) (e.g., PH20 hyaluronidase). For example, the pharmaceutical compositions provided herein are prepared at a pH of between or about between 6.5 to 7.8 such as between or about between 6.5 to 7.2, 7.0 to 7.8, 7.0 to 7.6 or 7.2 to 7.4. Reference to pH herein is based on measurement of pH at room temperature. It is understood that the pH can change during storage over time, but typically will remain between or between about pH 6.5 to or to about 7.8. For example, the pH can vary by ±0.1, 0.2, 0.3, 0.4, 0.5, 0.6, 0.7, 0.8, 0.9, 1.0, 1.2, 1.3, 1.4, 1.5 or more. Exemplary co-formulations provided herein have a pH of or of about 7.0±0.2, 7.1±0.2, 7.2±0.2, 7.3±0.2, 7.4±0.2, 7.5±0.2 or 7.6±0.2 when prepared. If necessary, pH can be adjusted using acidifying agents to lower the pH or alkalizing agents to increase the pH. Exemplary acidifying agents include, but are not limited to, acetic acid, citric acid, sulfuric acid, hydrochloric acid, monobasic sodium phosphate solution, and phosphoric acid. Exemplary alkalizing agents include, but are not limited to, dibasic sodium phosphate solution, sodium carbonate, or sodium hydroxide.

The compositions are generally prepared using a buffering agent that maintains the pH range. Any buffer can be used in formulations provided herein so long as it does not adversely affect the stability of the active agent(s) (e.g., PH20 hyaluronidase), and supports the requisite pH range required. Examples of particularly suitable buffers include Tris, succinate, acetate, phosphate buffers, citrate, aconitate, malate and carbonate. Those of skill in the art, however, will recognize that formulations provided herein are not limited to a particular buffer, so long as the buffer provides an acceptable degree of pH stability, or "buffer capacity" in the range indicated. Generally, a buffer has an adequate buffer capacity within about 1 pH unit of its pK (Lachman et al. In: The Theory and Practice of Industrial Pharmacy 3rd Edn. (Lachman, L., Lieberman, H A. and Kanig, J. L., Eds.), Lea and Febiger, Philadelphia, p. 458-460, 1986). Buffer suitability can be estimated based on published pK tabulations or can be determined empirically by methods well known in the art. The pH of the solution can be adjusted to the desired endpoint within the range as described above, for example, using any acceptable acid or base.

Buffers that can be included in the co-formulations provided herein include, but are not limited to, Tris (Tromethamine), histidine, phosphate buffers, such as dibasic sodium phosphate, and citrate buffers. Such buffering agents can be present in the co-formulations at concentrations between or about between 1 mM to 100 mM, such as 10 mM to 50 mM or 20 mM to 40 mM, such as at or about 30 mM. For example, such buffering agents can be present in the co-formulations in a concentration of or about 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 16 mM, 17 mM, 18 mM, 19 mM, 20 mM, 25 mM, 30 mM, 35 mM, 40 mM, 45 mM, 50 mM, 55 mM, 60 mM, 65 mM, 70 mM, 75 mM, or more.

iii. Preservative(s)

In examples herein, multi-dose formulations or formulations stored for prolonged periods contain an anti-microbially effective amount of preservative or mixture of preservatives in an amount to have a bacteriostatic or fungistatic effect. In particular examples, the preservatives are present in a sufficient concentration to provide the anti-microbial requirements of, for example, the United States Pharmacopoeia (USP) and the European Pharmacopoeia (EP), including the EP anti-microbial requirements (EPA) and the preferred EP anti-microbial requirements (EPB) (see Table 4). Since the presence of preservatives, and in particular phenolic preservatives, can have deleterious effects on the stability of PH20, such formulations typically contain a modified PH20 polypeptide that exhibits increased stability in the presence of preservatives, such as any described in Section C.1.b.i herein. Generally, the amount maintains the stability of the active agent(s) (e.g., PH20 hyaluronidase).

An anti-microbial effective amount of preservative is an amount that exhibits anti-microbial activity by killing or inhibiting the propagation of microbial organisms in a sample of the composition as assessed in an antimicrobial preservative effectiveness test (APET). One of skill in the art is familiar with the antimicrobial preservative effectiveness test and standards to be meet under the USP and EPA or EPB in order to meet minimum requirements. In general, the antimicrobial preservative effectiveness test involves challenging a composition with prescribed inoculums of suitable microorganisms, i.e., bacteria, yeast and fungi, storing the inoculated preparation at a prescribed temperature, withdrawing samples at specified intervals of time and counting the organisms in the sample (see, Sutton and Porter, (2002) *PDA Journal of Pharmaceutical Science and Technology* 56(4):300-311; The United States Pharmacopeial Convention, Inc., (effective Jan. 1, 2002), *The United States Pharmacopeia* 25$^{th}$ *Revision*, Rockville, Md., Chapter <51>Antimicrobial Effectiveness Testing; and European Pharmacopoeia, Chapter 5.1.3, Efficacy of Antimicrobial Preservation). The microorganisms used in the challenge generally include three strains of bacteria, namely *E. coli* (ATCC No. 8739), *Pseudomonas aeruginosa* (ATCC No. 9027) and *Staphylococcus aureus* (ATCC No. 6538), yeast (*Candida albicans* ATCC No. 10231) and fungus (*Aspergillus niger* ATCC No. 16404), all of which are added such that the inoculated composition contains $10^5$ or $10^6$ colony forming units (cfu) of microorganism per mL of composition. The preservative properties of the composition are deemed adequate if, under the conditions of the test, there is a significant fall or no increase, as specified in Table 3 in the number of microorganisms in the inoculated composition after the times and at the temperatures prescribed. The criteria for evaluation are given in terms of the log reduction in the number of viable microorganism as compared to the initial sample or the previous time point.

Non-limiting examples of preservatives that can be included in the co-formulations provided herein include, but are not limited to, phenol, meta-cresol (m-cresol), methylparaben, benzyl alcohol, thimerosal, benzalkonium chloride, 4-chloro-1-butanol, chlorhexidine dihydrochloride, chlorhexidine digluconate, L-phenylalanine, EDTA, bronopol (2-bromo-2-nitropropane-1,3-diol), phenylmercuric acetate, glycerol (glycerin), imidurea, chlorhexidine, sodium dehydroacetate, ortho-cresol (o-cresol), para-cresol (p-cresol), chlorocresol, cetrimide, benzethonium chloride, ethylparaben, propylparaben or butylparaben and any combination thereof. For example, formulations provided herein can contain a single preservative. In other examples, the formulations contain at least two different preservatives or at least three different preservatives. For example, formulations provided herein can contain two preservatives such as L-phenylalanine and m-cresol, L-phenylalanine and methylparaben, L-phenylalanine and phenol, m-cresol and methylparaben, phenol and methylparaben, m-cresol and phenol or other similar combinations. In one example, the preservative in the formulation contains at least one phenolic preservative. For example, the formulation contains phenol, m-cresol or phenol and m-cresol.

In the formulations provided herein, the total amount of the one or more preservative agents as a percentage (%) of mass concentration (w/v) in the formulation can be, for example, between from or between about from 0.1% to 0.4%, such as 0.1% to 0.3%, 0.15% to 0.325%, 0.15% to 0.25%, 0.1% to 0.2%, 0.2% to 0.3%, or 0.3% to 0.4%. Generally, the formulations contain less than 0.4% (w/v) preservative. For example, the co-formulations provided herein contain at least or about at least 0.1%, 0.12%, 0.125%, 0.13%, 0.14%, 0.15%, 0.16%0.17%, 0.175%, 0.18%, 0.19%, 0.2%, 0.25%, 0.3%, 0.325%, 0.35% but less than 0.4% total preservative.

In some examples, the formulations provided herein contain between or between about 0.1% to 0.25% phenol and between or about between 0.05% to 0.2% m-cresol, such as between or about between 0.10% to 0.2% phenol and between or about between 0.06% to 0.18% m-cresol, or between or about between 0.1% to 0.15% phenol and between or about between 0.08% to 0.15% m-cresol. For example, formulations provided herein contain or contain about 0.1% phenol and 0.075% m-cresol; 0.1% phenol and 0.15% m-cresol; 0.125% phenol and 0.075% m-cresol; 0.13% phenol and 0.075% m-cresol; 0.13% phenol and 0.08% m-cresol; 0.15% phenol and 0.175% m-cresol; or 0.17% phenol and 0.13% m-cresol.

iv. Stabilizers

In examples herein, the pharmaceutical compositions provided herein optionally can contain one or more other stabilizing agent to maintain the stability of the active agent(s) (e.g., PH20 hyaluronidase). Included among the types of stabilizers that can be contained in the formulations provided herein are amino acids, amino acid derivatives, amines, sugars, polyols, salts and buffers, surfactants, and other agents. The formulations provided herein contain at least one stabilizer. For example, the formulations provided herein contain at least one, two, three, four, five, six or more stabilizers. Hence, any one or more of an amino acids, amino acid derivatives, amines, sugars, polyols, salts and buffers, surfactants, and other agents can be included in the formulations herein. Generally, the formulations herein contain at least contain a surfactant and an appropriate buffer. Optionally, the formulations provided herein can contain other additional stabilizers. Other components include, for example, one or more tonicity modifiers, one or more anti-oxidation agents, or other stabilizer.

Exemplary amino acid stabilizers, amino acid derivatives or amines include, but are not limited to, L-Arginine, Glutamine, Glycine, Lysine, Methionine, Proline, Lys-Lys, Gly-Gly, Trimethylamine oxide (TMAO) or betaine. Exemplary sugars and polyols include, but are not limited to, glycerol, sorbitol, mannitol, inositol, sucrose or trehalose. Exemplary salts and buffers include, but are not limited to, magnesium chloride, sodium sulfate, Tris such as Tris (100 mM), or sodium Benzoate. Exemplary surfactants include, but are not limited to, poloxamer 188 (e.g., Pluronic® F68), polysorbate 80 (PS80), polysorbate 20 (PS20). Other stabilizers include, but are not limited to, hyaluronic acid (HA), human serum albumin (HSA), phenyl butyric acid, taurocholic acid, polyvinylpyrolidone (PVP) or zinc.

In particular examples herein, the formulations contain one or more detergents, such as surfactants, to maintain the stability of the active agent(s) (e.g., PH20 hyaluronidase). For example, surfactants can inhibit aggregation of PH20 and minimize absorptive loss. The surfactants generally are non-ionic surfactants. Surfactants that can be included in the formulations herein include, but are not limited to, partial and fatty acid esters and ethers of polyhydric alcohols such as of glycerol, or sorbitol, poloxamers and polysorbates. For example, exemplary surfactants in the -formulations herein include any one or more of poloxamer 188 (PLURONICS® such as PLURONIC® F68), TETRONICS®, polysorbate 20, polysorbate 80, PEG 400, PEG 3000, Tween® (e.g., Tween® 20 or Tween® 80), Triton® X-100, SPAN®, MYRJ®, BRIJ®, CREMOPHOR®, polypropylene glycols or polyethylene glycols. In some examples, the formulations herein contain poloxamer 188, polysorbate 20, polysorbate 80, generally poloxamer 188 (pluronic F68). The formulations provided herein generally contain at least one surfactant, such as 1, 2 or 3 surfactants.

In the formulations provided herein, the total amount of the one or more surfactants as a percentage (%) of mass concentration (w/v) in the formulation can be, for example, between from or between about from 0.005% to 1.0%, such as between from or between about from 0.01% to 0.5%, such as 0.01% to 0.1% or 0.01% to 0.02%. Generally, the formulations contain at least 0.01% surfactant and contain less than 1.0%, such as less than 0.5% or less than 0.1% surfactant. For example, the formulations provided herein can contain at or about 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08%, or 0.09% surfactant. In particular examples, the formulations provided herein contain or contain about 0.01% to or to about 0.05% surfactant.

Tonicity modifiers can be included in the formulation provided herein to produce a solution with the desired osmolality. The formulations provided herein have an osmolality of between or about between 245 mOsm/kg to 305 mOsm/kg. For example, the osmolality is or is about 245 mOsm/kg, 250 mOsm/kg, 255 mOsm/kg, 260 mOsm/kg, 265 mOsm/kg, 270 mOsm/kg, 275 mOsm/kg, 280 mOsm/kg, 285 mOsm/kg, 290 mOsm/kg, 295 mOsm/kg, 300 mOsm/kg or 305 mOsm/kg. In some examples, the formulations have an osmolality of or of about 275 mOsm/kg. Tonicity modifiers include, but are not limited to, glycerin, NaCl, amino acids, polyalcohols, trehalose, and other salts and/or sugars. The particular amount can be empirically determined in order to retain enzyme activity, and/or tonicity.

In other instances, glycerin (glycerol) is included in the formulations. For example, formulations provided herein typically contain less than 60 mM glycerin, such as less than 55 mM, less than 50 mM, less than 45 mM, less than 40 mM, less than 35 mM, less than 30 mM, less than 25 mM, less than 20 mM, less than 15 mM, 10 mM or less. The amount of glycerin typically depends on the amount of NaCl present: the more NaCl present in the formulation, the less glycerin is required to achieve the desired osmolality or osmolarity. Thus, for example, in formulations containing higher NaCl concentrations, little or no glycerin need be included in the formulation. In contrast, in formulations containing slightly lower NaCl concentrations, glycerin can be included. For example, formulations provided herein can contain glycerin at a concentration of 40 mM to 60 mM, such as less than 50 mM, such as 20 mM to 50 mM, for example at or about 50 mM.

The formulations provided herein also can contain antioxidants to reduce or prevent oxidation, in particular oxidation of the PH20 polypeptide. For example, oxidation can be effected by high concentrations of surfactant or hyaluronan oligomers. Exemplary antioxidants include, but are not limited to, cysteine, tryptophan and methionine. In particular examples, the antioxidant is methionine. The formulations provided herein can include an antioxidant at a concentration from between or from about between 5 mM to or to about 50 mM, such as 5 mM to 40 mM, 5 mM to 20 mM or 10 mM to 20 mM. For example, methionine can be provided in the formulations herein at a concentration from between or from about between 5 mM to or to about 50 mM, such as 5 mM to 40 mM, 5 mM to 20 mM or 10 mM to 20 mM. For example, an antioxidant, for example methionine, can be included at a concentration that is or is about 5 mM, 10 mM, 11 mM, 12 mM, 13 mM, 14 mM, 15 mM, 16 mM, 17 mM, 18 mM, 19 mM, 20 mM, 21 mM, 22 mM, 23 mM, 24 mM, 25 mM, 26 mM, 27 mM, 28 mM, 29 mM, 30 mM, 35 mM, 40 mM, 45 mM or 50 mM. In some examples, the formulations contain 10 mM to 20 mM methionine, such as or about 10 mM or 20 mM methionine.

The formulations provided herein also can contain an amino acid stabilizer, which contributes to the stability of the preparation. The stabilizer can be a non-polar or basic amino acid. Exemplary non-polar and basic amino acids include, but are not limited to, alanine, histidine, arginine, lysine, ornithine, isoleucine, valine, methionine, glycine and proline. For example, the amino acid stabilizer is glycine or proline, typically glycine. The stabilizer can be a single amino acid or it can be a combination of 2 or more such amino acids. The amino acid stabilizers can be natural amino acids, amino acid analogues, modified amino acids or amino acid equivalents. Generally, the amino acid is an L-amino acid. For example, when proline is used as the stabilizer, it is generally L-proline. It is also possible to use amino acid equivalents, for example, proline analogues. The concentration of amino acid stabilizer, for example glycine, included in the formulation ranges from 0.1 M to 1 M amino acid, typically 0.1 M to 0.75 M, generally 0.2 M to 0.5 M, for example, at least at or about 0.1 M, 0.15 M, 0.2 M, 0.25 M, 0.3 M, 0.35 M, 0.4 M, 0.45 M, 0.5 M, 0.6 M, 0.7 M, 0.75

M or more amino acid. The amino acid, for example glycine, can be used in a form of a pharmaceutically acceptable salt, such as hydrochloride, hydrobromide, sulfate, acetate, etc. The purity of the amino acid, for example glycine, should be at least 98%, at least 99%, or at least 99.5% or more.

In examples herein, if necessary, hyaluronidase inhibitors are included in a formulation to stabilize PH20, in particular to reduce the effects of otherwise destabilizing agents and conditions, such as, for example, low salt, high pH, the presence of preservatives and elevated temperatures, present in the formulation. Such a component generally is not required for pharmaceutical compositions containing a modified PH20 polypeptide as provided herein that exhibits increased stability under such conditions. When provided, the hyaluronidase inhibitor is provided at least at its equilibrium concentration. One of skill in the art is familiar with various classes of hyaluronidase inhibitors (see e.g., Girish et al. (2009) *Current Medicinal Chemistry*, 16:2261-2288, and references cited therein). One of skill in the art knows or can determine by standard methods in the art the equilibrium concentration of a hyaluronidase inhibitor in a reaction or stable composition herein.

An exemplary hyaluronidase inhibitor for use in the compositions herein is hyaluronan (HA). Hyaluronic acid (HA, also known as hyaluronan and hyaluronate) is the natural substrate for PH20. HA is a non-sulfated glycosaminoglycan that is widely distributed throughout connective, epithelial, and neural tissues. It is a polymer of up to 25,000 disaccharide units, themselves composed of D-glucuronic acid and D-N-acetylglucosamine. The molecular weight of HA ranges from about 5 kDa to 200,000 kDa. Any size HA can be used in the compositions as a stabilizer. In some examples, the HA is a disaccharide, composed of D-glucuronic acid and D-N-acetylglucosamine. In other examples, the HA is an oligosaccharide, such as a tetrasaccharide, containing 2 repeating disaccharide units, or alternatively, the HA used in the co-formulations provided herein can contain multiple repeating disaccharide units, such as 3, 4, 5, 6, 7, 8, 9, 10, 11, 12, 13, 14, 15, 16, 17, 18, 19, 20, 25, 30 or more disaccharide units. In another example, the HA used in the formulations provided herein has a molecular weight that is from or from about 5 kDa to or to about 5,000 kDa; from or from about 5 kDa to or to about 1,000 kDa; from or from about 5 kDa to or to about 500 kDa; or from or from about 5 kDa to or to about 200 kDa. Exemplary HA oligosaccharides for use in the formulations herein have a molecular weight of or of about 6.4 kDa, 74.0 kDa, or 234.4 kDa. The formulations can contain 1 mg/mL to 20 mg/mL HA, 8 mg/mL to 12 mg/mL, such as at least or about 1 mg/mL, 2 mg/mL, 3 mg/mL, 4 mg/mL, 5 mg/mL, 6 mg/mL, 7 mg/mL, 8 mg/mL, 9 mg/mL, 10 mg/mL, 11 mg/mL, 12 mg/mL, 13 mg/mL, 14 mg/mL, 15 mg/mL, 16 mg/mL, 17 mg/mL, 18 mg/mL, 19 mg/mL or 20 mg/mL or more HA. In some examples, the molar ratio of HA to PH20 is or is about 100,000:1, 95,000:1, 90,000:1, 85,000:1, 80,000:1, 75,000:1, 70,000:1, 65,000:1, 60,000:1, 55,000:1, 50,000:1, 45,000:1, 40,000:1, 35,000:1, 30,000:1, 25,000:1, 20,000:1, 15,000:1, 10,000:1, 5,000:1, 1,000:1, 900:1, 800:1, 700:1, 600:1, 500:1, 400:1, 300:1, 200:1, or 100:1 or less.

In some examples, a nicotinic compound is used as a stabilizing agent. Nicotinic compounds include, but are not limited to, nicotinamide, nicotinic acid, niacin, niacinamide, vitamin B3 and/or salts thereof and/or any combination thereof. In particular applications, the stabilizing agent can include a nicotinic compound an amino acid or amino acids (see e.g., International Publication No. WO2010149772). For example, the amino acid can be arginine, glutamic acid and/or salts thereof or combinations thereof.

2. Compositions for Other Routes of Administration

Depending upon the condition treated other routes of administration, such as topical application, transdermal patches, oral and rectal administration are also contemplated herein.

For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration. Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Topical mixtures are prepared as described for the local and systemic administration. The resulting mixtures can be solutions, suspensions, emulsion or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof may be formulated as aerosols for topical application, such as by inhalation (see, e.g., U.S. Pat. Nos. 4,044,126, 4,414,209, and 4,364,923, which describe aerosols for delivery of a steroid useful for treatment of inflammatory diseases, particularly asthma). These formulations, for administration to the respiratory tract, can be in the form of an aerosol or solution for a nebulizer, or as a microfine powder for insufflation, alone or in combination with an inert carrier such as lactose. In such a case, the particles of the formulation will typically have diameters of less than 50 microns, or less than 10 microns.

The compounds can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in an optionally buffered aqueous solution of, for example, 0.1 to 0.2 M concentration with respect to the active compound. Formulations suitable for transdermal administration also can be delivered by iontophoresis (see, e.g., Tyle, P, *Pharmaceutical Research* 3(6):318-326 (1986)) and typically take the form of an optionally buffered aqueous solution of the active compound.

Pharmaceutical compositions also can be administered by controlled release formulations and/or delivery devices (see e.g., in U.S. Pat. Nos. 3,536,809; 3,598,123; 3,630,200; 3,845,770; 3,916,899; 4,008,719; 4,769,027; 5,059,595; 5,073,543; 5,120,548; 5,591,767; 5,639,476; 5,674,533 and 5,733,566).

3. Dosages and Administration

The modified PH20 polypeptides provided herein can be formulated as pharmaceutical compositions for single dosage or multiple dosage administration. The PH20 polypeptide is included in an amount sufficient to exert a therapeutically useful effect in the absence of undesirable side effects on the patient treated. The therapeutically effective concentration can be determined empirically by testing the polypeptides in known in vitro and in vivo systems such as by using the assays provided herein or known in the art (see e.g., Taliani et al. (1996) *Anal. Biochem.*, 240:60-67; Filocamo et al. (1997) *J Virology*, 71:1417-1427; Sudo et al. (1996) *Antiviral Res.* 32:9-18; Bouffard et al. (1995) *Virology*, 209:52-59; Bianchi et al. (1996) *Anal. Biochem.*, 237: 239-244; Hamatake et al. (1996) *Intervirology* 39:249-258; Steinkuhler et al. (1998) *Biochem.*, 37:8899-8905; D'Souza et al. (1995) *J. Gen. Virol*, 76:1729-1736; Takeshita et al. (1997) *Anal. Biochem.*, 247:242-246; see also e.g., Shimizu et al. (1994) *J. Virol.* 68:8406-8408; Mizutani et al. (1996) *J. Virol.* 70:7219-7223; Mizutani et al. (1996) *Biochem. Biophys. Res. Commun.*, 227:822-826; Lu et al. (1996) *Proc. Natl. Acad. Sci* (USA), 93:1412-1417; Hahm et al., (1996) *Virology*, 226:318-326; Ito et al. (1996) *J. Gen. Virol.*, 77:1043-1054; Mizutani et al. (1995) *Biochem. Biophys. Res. Commun.*, 212:906-911; Cho et al. (1997) *J. Virol. Meth.* 65:201-207 and then extrapolated therefrom for dosages for humans.

The amount of a modified PH20 to be administered for the treatment of a disease or condition can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease.

Hence, it is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

Typically, a therapeutically effective dose of a modified PH20 enzyme is at or about 10 Unit (U) to 500,000 Units, 100 Units to 100,000 Units, 500 Units to 50,000 Units, 1000 Units to 10,000 Units, 5000 Units to 7500 Units, 5000 Units to 50,000 Units, or 1,000 Units to 10,000 Units, generally 1,000 to 50,000 Units, in a stabilized solution or suspension or a lyophilized form. For example, a PH20 polypeptide, can be administered at a dose of at least or about at least or 10 U, 20 U, 30 U, 40 U, 50 U, 100 U, 150 U, 200 U, 250 U, 300 U, 350 U, 400 U, 450 U, 500 U, 600 U, 700 U, 800 U, 900 U, 1000 U, 2,000 U, 3,000 U, 4,000 Units, 5,000 U or more. The formulations can be provided in unit-dose forms such as, but not limited to, ampoules, syringes and individually packaged tablets or capsules.

The PH20 enzyme can be administered alone, or with other pharmacologically effective agent(s) or therapeutic agent(s), in a total volume of 0.1-100 mL, 1-50 mL, 10-50 mL, 10-30 mL, 1-20 mL, or 1-10 mL, typically 10-50 mL. Typically, volumes of injections or infusions of a PH20-containing composition are at least or at least about 0.01 mL, 0.05 mL, 0.1 mL, 0.2 mL, 0.3 mL, 0.4 mL, 0.5 mL, 1 mL, 2 mL, 3 mL, 4 mL, 5 mL, 6 mL, 7 mL, 8 mL, 9 mL, 10 mL, 20 mL, 30 mL, 40 mL, 50 mL or more. The formulations provided herein contain a modified PH20 polypeptide in an amount between or about between 30 Units/mL to 3000 U/mL, 300 U/mL to 2000 U/mL or 600 U/mL to 2000 U/mL or 600 U/mL to 1000 U/mL, such as at least or about at least 30 U/mL, 35 U/mL, 40 U/mL, 50 U/mL, 100 U/mL, 200 U/mL, 300 U/mL, 400 U/mL, 500 U/mL, 600 U/mL, 700 U/mL, 800 U/mL, 900 U/mL, 1000 U/mL, 2000 U/mL or 3000 U/mL. For example, the formulations provided herein contain a PH20 that is in an amount that is at least 100 U/mL to 1000 U/mL, for example at least or about at least or about or 600 U/mL.

The PH20 polypeptide can be provided as a solution in an amount that is at least or about or is 100 U/mL, 150 U/mL, 200 U/mL, 300 U/mL, 400 U/mL, 500 U/mL, 600 U/mL, 800 U/mL or 1000 U/mL, or can be provided in a more concentrated form, for example in an amount that is at least or about or is 2000 U/mL, 3000 Units/mL, 4000 U/mL, 5000 U/mL, 8000 U/mL, 10,000 U/mL or 20,000 U/mL for use directly or for dilution to the effective concentration prior to use. The PH20 polypeptide compositions can be provided as a liquid or lyophilized formulation.

When the PH20 is co-formulated with a therapeutic agent, dosages can be provided as a ratio of the amount of a PH20 polypeptide to the amount of therapeutic agent administered. For example, a PH20 polypeptide can be administered at 1 hyaluronidase U/therapeutic agent U (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more.

The formulations provided herein, including co-formulations and/or stable formulations, can be prepared for single dose administration, multiple dose administration or continuous infusion administrations. Implantation of a slow-release or sustained-release system, such that a constant level of dosage is maintained (see e.g., U.S. Pat. No. 3,710,795), is also contemplated herein.

For example, formulations of pharmaceutically therapeutically active compounds and derivatives thereof are provided for administration to humans and animals in unit dosage forms or multiple dosage forms. For example, compounds can be formulated as tablets, capsules, pills, powders, granules, sterile parenteral solutions or suspensions, oral solutions or suspensions, or oil-water emulsions containing suitable quantities of the compounds or pharmaceutically acceptable derivatives thereof. Each unit dose contains a predetermined quantity of therapeutically active compound(s) sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose forms. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Compositions provided herein typically are formulated for administration by subcutaneous route, although other routes of administration are contemplated, such as any route known to those of skill in the art including intramuscular, intraperitoneal, intravenous, intradermal, intralesional, intraperitoneal injection, epidural, vaginal, rectal, local, otic, transdermal administration or any route of administration. Formulations suited for such routes are known to one of skill in the art. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition.

The most suitable route in any given case depends on a variety of factors, such as the nature of the disease, the tolerance of the subject to a particular administration route, the severity of the disease, and the particular composition that is used. Typically, the compositions provided herein are administered parenterally. In some examples, modified PH20 polypeptide compositions are administered so that they reach the interstitium of skin or tissues, thereby degrading the interstitial space for subsequent delivery of a therapeutic agent. Thus, in some examples, direct administration under the skin, such as by subcutaneous administration methods, is contemplated. Thus, in one example, local administration can be achieved by injection, such as from a syringe or other article of manufacture containing an injection device such as a needle. In another example, local administration can be achieved by infusion, which can be facilitated by the use of a pump or other similar device. Other modes of administration also are contemplated. For example, modified PH20 polypeptides, included conjugated forms with increased half-life such as PEGylated forms thereof, can be administered intravenously. Pharmaceutical compositions can be formulated in dosage forms appropriate for each route of administration.

Administration methods can be employed to decrease the exposure of selected modified PH20 polypeptides to degradative processes, such as proteolytic degradation and immunological intervention via antigenic and immunogenic responses. Examples of such methods include local administration at the site of treatment. PEGylation of therapeutics increases resistance to proteolysis, increases plasma half-life, and decreases antigenicity and immunogenicity. Examples of PEGylation methodologies are known in the art (see for example, Lu and Felix, Int. J. Peptide Protein Res., 43: 127-138, 1994; Lu and Felix, Peptide Res., 6: 140-6, 1993; Felix et al., Int. J. Peptide Res., 46: 253-64, 1995; Benhar et al., J. Biol. Chem., 269: 13398-404, 1994; Brumeanu et al., J. Immunol., 154: 3088-95, 1995; see also, Caliceti et al. (2003) Adv. Drug Deliv. Rev. 55(10): 1261-77 and Molineux (2003) Pharmacotherapy 23 (8 Pt 2):3S-8S). PEGylation also can be used in the delivery of nucleic acid molecules in vivo. For example, PEGylation of adenovirus can increase stability and gene transfer (see, e.g., Cheng et al. (2003) Pharm. Res. 20(9): 1444-51).

Various other delivery systems are known and can be used to administer selected PH20 polypeptides, such as but not limited to, encapsulation in liposomes, microparticles, microcapsules, recombinant cells capable of expressing the compound, receptor mediated endocytosis, and delivery of nucleic acid molecules encoding selected PH20 polypeptides such as retrovirus delivery systems.

Hence, in certain embodiments, liposomes and/or nanoparticles also can be employed with administration of soluble PH20 polypeptides. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 μm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios of lipid to water, liposomes form. Physical characteristics of liposomes depend on the pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use herein, and such particles can be easily made.

4. Exemplary PH20-Insulin Co-Formulation

Provided herein are stable co-formulations of a fast acting insulin, such as a rapid acting (fast-acting) insulin analog, and a modified PH20 polypeptide. Any of the modified PH20 polypeptides provided herein can be included in a co-formulation with insulin, such as any of the co-formulations described in U.S. application Ser. No. 13/507,263 or 13/507,262 or in International PCT Application Serial No. PCT/US2012/042816.

In particular, the modified PH20 polypeptide is a modified PH20 polypeptide that exhibits increased stability under denaturation conditions, such as any set forth in Sections C.1.b. In particular, the PH20 polypeptide is a modified PH20 polypeptide that exhibits increased stability to one or more phenolic preservatives, such as any set forth in Section C.1.b.i. For example, the PH20 polypeptide is a modified PH20 polypeptide that contains an amino acid replacement with P at a position corresponding to position 204 with reference to amino acid positions set forth in SEQ ID NO:3, such as F204P with reference to any of SEQ ID NOS: 3, 7 or 32-66. In other examples, the PH20 polypeptide is a modified PH20 polypeptide that contains an amino acid replacement with R at a position corresponding to position 58 with reference to amino acid positions set forth in SEQ ID NO:3, such as V58R with reference to any of SEQ ID NOS: 3, 7 or 32-66.

The fast acting insulin can be a regular insulin or a rapid acting (fast-acting) insulin analog. Insulin is a polypeptide that when processed is composed of 51 amino acids containing an A- and B-chain. Generally, insulin contains an A-chain of about 21 amino acids and a B-chain of about 30 amino acids. The A- and B-chains are linked by disulfide bridges. Exemplary regular insulins include, for example, a human insulin (with an A chain having a sequence of amino acids set forth in SEQ ID NO:862 and a B chain having a sequence of amino acids set forth in SEQ ID NO: 863) or a porcine insulin (with an A chain having a sequence of amino acids set forth as amino acid residue positions 88-108 of SEQ ID NO: 864 and a B chain having a sequence of amino acids set forth as amino acid residue positions 25-54 of SEQ ID NO:864). Exemplary fast-acting insulin analogs are insulin variants that contain one or more amino acid modifications compared to a human insulin set forth in SEQ ID NO: 862 and 863 (A and B chains). For example, exemplary insulin analogs are known to one of skill in the art, and include, but are not limited to, glulisine having an A-chain set forth in SEQ ID NO: 862 and a B-chain that is a variant of SEQ ID NO: 863 (B-chain; LysB3, GluB29), HMR-1 153 having an A-chain set forth in SEQ ID NO:862 and a B-chain that is a variant of SEQ ID NO:863 (B-chain; LysB3, IleB28), insulin aspart having an A-chain set forth in SEQ ID NO:862 and a B-chain that is a variant of SEQ ID NO:863 (B-chain; AspB28), and insulin lispro having an A-chain set forth in SEQ ID NO:862 and a B-chain that is a variant of SEQ ID NO:863 (B-chain; LysB28, ProB29). In every instance above, the nomenclature of the analogs is based on a description of the amino acid substitution at specific positions on the A or B chain of insulin, numbered from the N-terminus of the chain, in which the remainder of the sequence is that of natural human insulin. Exemplary of such analog forms, are set forth in SEQ ID NOS:862 (A-chain) and having a B-chain set forth in any of SEQ ID NOS: 865-867.

The co-formulations are stable as a liquid formulation for prolonged periods of time for at least 1 month at temperatures from or from about 2° C. to 8° C., inclusive, or for at least 3 days at a temperature from or from about 30° C. to 42° C., inclusive. For example, the co-formulations are stable and retain activity of the PH20 hyaluronidase and insulin at "refrigerator" conditions, for example, at 2° C. to 8° C., such as at or about 4° C., for at least at least 2 months, 3 months, 4 months, 5 months, 6 months, or 7 months, at least 8 months, at least 9 months, at least 10 months, at least 11 months, at least 12 months, 13 months, 14 months, 15 months, 16 months, 17 months, 18 months, 19 months, 20 months, 21 months, 22 months, 23 months, 24 months, 25 months, 26 months, 27 months, 28 months, 29 months or 30 months or more. In another example, the formulations provided herein are stable and retain activity of the PH20 hyaluronidase and insulin at room temperature for example at 18° C. to 32° C., generally 20° C. to 32° C., such as 28° C. to 32° C., for at least 2 weeks to 1 year, for example, at least 3 weeks, 4 weeks, 2 months, 3 months, 4 months, 5 months, 6 months, at least 7 months, at least 8 months, at least 9 months, or at least 1 year or more. In a further example, the formulations provided herein are stable and retain activity of the PH20 hyaluronidase and insulin at elevated temperatures of about or greater than 30° C., generally from or from about 30° C. to 42° C., such as 32° C. to 37° C. or 35° C. to 37° C. or about or 37° C. for at least 4 days, 5 days, 6 days, 7 days, 8 days, 9 days, 10 days, 11 days, 12 days, 13 days, 14 days, 15 days, 20 days, 21 days, 22 days, 23 days, 24 days, 25 days, 26 days, 27 days, 28 days, 29 days, 30 days, 35 days, 40 days, 45 days, 50 days, 60 days or more.

Assays to assess stability of active agents are well-known to one of skill in the art. Section G provides exemplary assays to assess stability of PH20 hyaluronidase. The stability of insulin can be assessed using similar methods well-known to one of skill in the art. For example, insulin stability and solubility can be assessed by visual assessment (e.g., including changes in color, clarity, presence of aggregates or clumping and material adhesion, or frosting), acid clarification, optical microscopy, reversed phase high performance liquid chromatography (RP-HPLC), in vitro or in vivo bioassays and denaturing and non-denaturing size exclusion chromatography (SEC). In vitro or in vivo bioassays for insulin activity include, but are not limited to, a competitive binding assay using cells expressing insulin receptors (e.g., human placental cell membranes) and a radiolabeled insulin (see e.g., Weiss et al., (2001) *J. Biol. Chem.* 276:40018-40024; Duttaroy et al., (2005) *Diabetes* 54:251-258); insulin-stimulated glucose uptake (Louveau et al., (2004) *J Endocrin.* 181:271-280, Duttaroy et al., (2005) *Diabetes* 54:251-258); assays to assess glucose production in the presence of insulin (Wang et al., (2000) *J. Biochem.*, 275:14717-14721, Duttaroy et al., (2005) *Diabetes* 54:251-258); and studies using diabetic and/or healthy animal models (Atkinson et al., (1999) *Nature Med.* 5:601-604;

Nagoya-Shibata-Yasuda (NSY) mice, Zucker diabetic fatty (ZDF) rats and Gato-Katazaki (GK) rats (Cefalu (2006) *ILAR Journal* 47:186-198).

Examples of such formulations contain 100 U/mL to 1000 U/mL of a modified PH20 polypeptide, and in particular at or about or at least 600 U/mL; 10 U/mL to 1000 U/mL of a fast-acting insulin, and in particular at or at least or about 100 U/mL; NaCl at a concentration of between or about between 80-140 mM; a pH of between or about between 7.0 to 7.8; a buffering agent that maintains the pH range of between or about between 7.0 to 7.8; 0.1% to 0.4% preservative as a mass concentration (w/v). Optionally, a further stabilizing agent can be included. For example, the co-formulations provided herein contain 1 mM to 100 mM of a buffering agent. For example, the co-formulations provided herein contain 0.005% to 0.5% surfactant. Exemplary co-formulations provided herein also can contain less than 60 mM glycerin (glycerol) and 2 mM to or to about 50 mM of an antioxidant.

The following stable formulations are exemplary only and provide a platform from which minor adjustments can be made. It is understood that very small changes in the concentrations of the various excipients and other components (e.g., ±15% of the stated concentrations), or small changes in pH, can be made while retaining some if not all of the insulin solubility and stability and PH20 stability. Further changes also can be made by adding or removing excipients. For example, the type of stabilizing surfactant can be changed.

For example, the exemplary co-formulations herein contain 100 U/mL to 1000 U/mL of a modified PH20 polypeptide, and in particular at least or about at least or about 600 U/mL of a modified PH20 polypeptide; 10 U/mL to 1000 U/mL of a fast-acting insulin, and in particular at least or about at least or about 100 U/mL of a fast-acting insulin; from or from about 10 mM to or to about 50 mM Tris (e.g., from or from about 20 mM to 40 mM Tris, such as or as about 20 mM, 25 mM, 30 mM, 35 mM or 40 mM Tris); from or from about 80 mM to or to about 160 mM NaCl (e.g., at or about 80 mM, 90 mM, 100 mM, 110 mM 120 mM, 130 mM, 140 mM, 150 mM or 160 mM NaCl); from or from about 2 mM to or to about 50 mM methionine (e.g., at or about 5 mM, 10 mM, 20 mM, 30 mM, 40 mM or 50 mM methionine); from or from about 0 mM to or to about 50 mM glycerin (e.g., at or about 5 mM, 10 mM, 20 mM, 30 mM, 40 mM or 50 mM glycerin); from or from about 0.005% to or to about 0.5% poloxamer 188, such as 0.01% to 0.05% (e.g., at or about 0.01%, 0.02%, 0.03%, 0.04% or 0.05% poloxamer 188); from or from about 0.05% to or to about 0.25% phenol (e.g., at or about 0.1%, 0.12%, 0.125%, 0.13%, 0.14%, 0.15%, 0.16% or 0.17% phenol); and from or from about 0.05% to or to about 0.4% m-cresol (e.g., at or about 0.075%, 0.08%, 0.09%, 0.1%, 0.12%, 0.13%, 0.14%, 0.15%, 0.16% or 0.17% m-cresol). The formulations are prepared with a pH from or from about 7.0 to or to about 7.6 (e.g., at or about pH 7.0, 7.1, 7.2, 7.3, 7.4, 7.5 or 7.6). In further examples, zinc is included at a concentration of or about 0.017 mg/100 U, 0.018 mg/100 U, 0.02 mg/100 U, 0.022 mg/100 U or 0.024 mg/100 U insulin.

In particular examples, the fast acting insulin is insulin aspart, insulin lispro or insulin glulisine. Exemplary co-formulations provided herein that contain a modified PH20 polypeptide and insulin lispro are those that contain from or about 25 mM to or to about 35 mM Tris (e.g., at or about 30 mM Tris); from or from about 70 mM to or to about 100 mM NaCl (e.g., at or about 80 mM or 100 mM NaCl); from or from about 10 mM to or to about 30 mM methionine (e.g., at or about 10 mM or 20 mM methionine); from or from about 40 mM to or to about 60 mM glycerin (e.g., at or about 50 mM glycerin); from or from about 0.005% to or to about 0.05% poloxamer 188 (e.g., at or about 0.01% poloxamer 188); from or from about 0.017 mg zinc/100 U insulin to or to about 0.024 mg zinc/100 U insulin (e.g., 0.017 mg zinc/100 U insulin, 0.018 mg/100 U, 0.02 mg/100 U, 0.022 mg/100 U or 0.024 mg zinc/100 U insulin); from or from about 0.08% to or to about 0.17% phenol (e.g., 0.1%, 0.125% or 0.13% phenol); and from or from about 0.07% to or to about 0.17% m-cresol (e.g., 0.075%, 0.08%, 0.13% or 0.15% m-cresol). For example, the co-formulations can contain at or about 0.1%) phenol and 0.015% m-cresol; at or about 0.125% phenol and 0.075% m-cresol; at or about 0.13% phenol and 0.075%) m-cresol; at or about 0.13% phenol and 0.08% tri-cresol; or at or about 0.17% phenol and 0.13% m-cresol. Such formulations of insulin lispro and a modified PH20 polypeptide are prepared with a pH of or about 7.0 to or to about 7.5 (typically a pH of or about pH 7.2).

Exemplary co-formulations provided herein that contain a modified PH20 polypeptide and insulin aspart are those that contain from or from about 25 mM to or to about 35 mM Tris (e.g., at or about 30 mM Tris); from or from about 70 mM to or to about 120 mM NaCl (e.g., at or about 80 mM or 100 mM NaCl); from or from about 2 mM to or to about 30 mM methionine, such as 2 mM to 10 mM or 5 mM to 30 mM methionine (e.g., at or about 5 mM, 10 mM or 20 mM methionine); from or from about 0.005% to or to about 0.05% poloxamer 188 (e.g., at or about 0.01% poloxamer 188); from or from about 0.08% to or to about 0.17% phenol (e.g., 0.1%, 0.125% or 0.13% phenol); and from or from about 0.07% to or to about 0.17% m-cresol (e.g., 0.075%, 0.08%, 0.13% or 0.15% m-cresol). For example, the co-formulations can contain at or about 0.1% phenol and 0.015% m-cresol; at or about 0.125% phenol and 0.075% m-cresol; at or about 0.13% phenol and 0.075% m-cresol; at or about 0.13% phenol and 0.08% m-cresol; or at or about 0.17% phenol and 0.13% m-cresol. Such formulations of insulin aspart and a modified PH20 polypeptide are prepared with a pH of or about 7.0 to or to about 7.6 (typically a pH of or about pH 7.4 or 7.3).

Further exemplary formulations provided herein that contain a modified PH20 polypeptide and insulin aspart are those that do not contain phenol. Such exemplary formulations contain from or from about 25 mM to or to about 35 mM Tris (e.g., at or about 30 mM Tris); from or from about 70 mM to or to about 120 mM NaCl (e.g., at or about 80 mM or 100 mM NaCl); from or from about 2 mM to or to about 30 mM methionine, such as 2 mM to 10 mM or 5 mM to 30 mM methionine (e.g., at or about 5 mM, 10 mM or 20 mM methionine); from or from about 0.005% to or to about 0.05% poloxamer 188 (e.g., at or about 0.01% poloxamer 188); and from or from about 0.07% to or to about 0.4% m-cresol, such as from or from about 0.2% to 0.4% m-cresol (e.g., 0.3%, 0.315%, 0.35%, 0.4% m-cresol). Such formulations of insulin aspart and a modified PH20 polypeptide are prepared with a pH of or about 7.0 to or to about 7.6 (typically a pH of or about pH 7.4 or 7.3).

Exemplary co-formulations provided herein that contain a modified PH20 polypeptide and insulin glulisine are those that contain from or from about 25 mM to or to about 35 mM Tris (e.g., at or about 30 mM Tris); from or from about 100 mM to or to about 150 mM NaCl (e.g., at or about 100 mM or 140 mM NaCl); from or from about 10 mM to or to about 30 mM methionine (e.g., at or about 10 mM or 20 mM methionine); from or from about 40 mM to or to about 60 mM glycerin (e.g., at or about 50 mM glycerin); from or from about 0.005% to or to about 0.05% poloxamer 188 (e.g., at or about 0.01% poloxamer 188); from or from about 0.08% to or to about 0.17% phenol (e.g., 0.1%, 0.125% or 0.13% phenol); and from or from about 0.07% to or to about 0.17% m-cresol (e.g., 0.075%, 0.08%, 0.13% or 0.15% m-cresol). For example, the co-formulations can contain at or about 0.1% phenol and 0.015% m-cresol; at or about 0.125% phenol and 0.075% m-cresol; at or about 0.13% phenol and 0.075% m-cresol; at or about 0.13% phenol and 0.08% m-cresol; or at or about 0.17% phenol and 0.13% m-cresol. Such formulations of insulin glulisine and a modified PH20 polypeptide are prepared with a pH of or about 7.0 to or to about 7.6 (typically a pH of or about pH 7.4).

5. Packaging, Articles of Manufacture and Kits

Pharmaceutical compounds of modified PH20 polypeptides, or nucleic acids encoding such polypeptides, or derivatives or variants thereof can be packaged as articles of manufacture containing packaging material, a pharmaceutical composition which is effective for treating a disease or disorder, and a label that indicates that the pharmaceutical composition or therapeutic molecule is to be used for treating the disease or disorder. Combinations of a selected modified PH20 polypeptide, or a derivative or variant thereof and an therapeutic agent also can be packaged in an article of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. The articles of manufacture can include a needle or other injection device so as to facilitate administration (e.g., sub-epidermal administration) for local injection purposes. A wide array of formulations of the compounds and compositions provided herein are contemplated including a modified PH20 polypeptide and a therapeutic agent, such as a fast-acting insulin, known to treat a particular disease or disorder. The choice of package depends on the PH20 and/or therapeutic agent, and whether such compositions will be packaged together or separately. In one example, the PH20 can be packaged as a mixture with the therapeutic agent. In another example, the components can be packaged as separate compositions Modified PH20 polypeptides, therapeutic agents and/or articles of manufacture thereof also can be provided as kits. Kits can include a pharmaceutical composition described herein and an item for administration provided as an article of manufacture. For example a PH20 polypeptide can be supplied with a device for administration, such as a syringe, an inhaler, a dosage cup, a dropper, or an applicator. The compositions can be contained in the item for administration or can be provided separately to be added later. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the selected protease in a subject.

G. Methods of Assessing PH20 Activity and Stability

Assays can be used to assess the stability and activity of the PH20 polypeptides provided herein. The assays can be used to assess the hyaluronidase activity of the PH20 polypeptide under particular conditions, temperature, and/or over time. Such assays can be used, for example, to determine the stability of the PH20 polypeptide under specific denaturation conditions, including, but not limited to, elevated temperatures greater than or about or 30° C. (e.g., 30° C. to 42° C. such as or about 37° C.), agitation, presence of excipients (e.g., preservative), or low or no NaCl (salt). For example, stability under specific conditions can be monitored by assessing activity, solubility, and stability (e.g., formation of aggregates, etc.) in the absence of exposure to the denaturation condition and then at various time points thereafter in the presence of the condition. Hence, stability can be assessed over time. Stability also can be assessed by comparing any one or more of activity, solubility or aggregation in the presence of one or more denaturation conditions compared to a native, wildtype or reference PH20 polypeptide. The assays also can be used make minor adjustments to the formulations provided herein while retaining the stability of both active agents.

1. Hyaluronidase Activity

The activity of a modified PH20 polypeptide can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with a reagent that precipitates it, such as acidified serum or cetylpyridinium chloride (CPC). The activity is measured by incubating hyaluronidase with sodium hyaluronate (hyaluronic acid) for a set period of time (e.g., 10 minutes) and then precipitating the undigested sodium hyaluronate with the addition of acidified serum or CPC. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase (see e.g., Frost and Stern (1997) *Anal. Biochem.* 251:263-269, U.S. Pat. Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity.

Other assays to measure hyaluronidase activity also are known in the art and can be used in the methods herein (see e.g., Delpech et al., (1995) *Anal. Biochem.* 229:35-41; Takahashi et al., (2003) *Anal. Biochem.* 322:257-263).

Many hyaluronidase assays have been based upon the measurement of the generation of new reducing N-acetylamino groups (Bonner and Cantey, Clin. Chim. Acta 13:746-752, 1966), or loss of viscosity (De Salegui et al., Arch. Biochem. Biophys. 121:548-554, 1967) or turbidity (Dorfman and Ott, J. Biol. Chem. 172:367, 1948). With purified substrates all of these methods suffice for determination of the presence or absence of endoglycosidase activity.

Substantially purified glycosaminoglycan substrates can also be used in a Gel Shift Assay. Glycosaminoglycans are mixed with recombinant PH20, such as a soluble PH20, to test for endoglycosidase activity that results in a shift in substrate mobility within the gel. Examples of such substrates include, but are not limited to, chondroitin-4 and 6 sulfate, dermatan sulfate, heparan-sulfate, which can be obtained from Sigma Chemical. Human umbilical cord Hyaluronan can be obtained from ICN. For example, each test substrate can be diluted to at or about 0.1 mg/mL in a buffer range from pH 3.5-7.5. In such an exemplary assay, at or about 10 μl samples of purified soluble PH20 or conditioned media from PH20 expressing cells can be mixed with at or about 90 μl of test substrate in desired buffer and incubated for 3 hours at 37° C. Following incubation, samples are neutralized with sample buffer (Tris EDTA pH 8.0, Bromophenol Blue and glycerol) followed by electrophoresis. Glycosaminoglycans can be detected using any method known in the art, for example, glycosaminoglycans can be detected by staining the gels using 0.5% Alcian Blue in 3% Glacial Acetic Acid overnight followed by destaining in 7% Glacial Acetic Acid. Degradation is determined by comparison of substrate mobility in the presence and absence of enzyme.

Hyaluronidase activity can also be detected by substrate gel zymography (Guentenhoner et al. (1992) *Matrix* 12:388-396). In this assay, a sample is applied to an SDS-PAGE gel containing hyaluronic acid and the proteins in the sample separated by electrophoresis. The gel is then incubated in an enzyme assay buffer and subsequently stained to detect the hyaluronic acid in the gel. Hyaluronidase activity is visualized as a cleared zone in the substrate gel.

The ability of a PH20 polypeptide, including a modified PH20 polypeptide provided herein, to act as a spreading or diffusing agent also can be assessed. For example, trypan blue dye can be injected subcutaneously with or without a PH20 polypeptide into the lateral skin on each side of nude mice. The dye area is then measured, such as with a microcaliper, to determine the ability of the PH20 polypeptide to act as a spreading agent (U.S. Pat. Pub. No. 20060104968).

The functional activity of a PH20 polypeptide can be compared and/or normalized to a reference standard using any of these assays. This can be done to determine what a functionally equivalent amount of a PH20 polypeptide is. For example, the ability of a PH20 polypeptide to act as a spreading or diffusing agent can be assessed by injecting it into the lateral skin of mice with trypan blue, and the amount required to achieve the same amount of diffusion as, for example, 100 units of a Hyaluronidase Reference Standard, can be determined. The amount of PH20 polypeptide required is, therefore, functionally equivalent to 100 hyaluronidase units.

2. Solubility

The solubility of a PH20 polypeptide can be determined by any method known to one of the skill in the art. One method for determining solubility is detergent partitioning. For example, a soluble PH20 polypeptide can be distinguished, for example, by its partitioning into the aqueous phase of a Triton® X-114 solution at 37° C. (Bordier et al., (1981) *J. Biol. Chem.*, 256:1604-1607). Membrane-anchored polypeptides, such as lipid-anchored hyaluronidases, including GPI-anchored hyaluronidases, will partition into the detergent-rich phase, but will partition into the detergent-poor or aqueous phase following treatment with Phospholipase C. Phospholipase C is an enzyme that cleaves the phospho-glycerol bond found in GPI-anchored proteins. Treatment with PLC will cause release of GPI-linked proteins from the outer cell membrane.

3. Purity, Crystallization or Aggregation

The stability of a PH20 polypeptide provided herein also can be assessed using other methods and assays known in the art. In addition to assessing stability based on hyaluronidase activity, stability can be assessed by visual inspection, percent recovery, protein purity and apparent melting temperature.

For example, protein purity can be measured by reversed phase high performance liquid chromatography (RP-HPLC). Protein purity, as determined by RP-HPLC, is the percent of the main PH20 protein peak present, as compared to all of the protein species present. Thus, RP-HPLC, and similar methods known to one of skill in the art, can assess degradation of the enzyme. Protein purity can be assessed over time. Protein purity also can be assessed in the presence of one or more denaturation conditions and in varying amounts thereof. Percent recovery also can be determined as the relative percentage of the polypeptide under various conditions (denaturation conditions, time of storage, mode of storage such as vessel or container, or other similar parameters that can be altered) as compared to a reference sample. PH20 polypeptide stability also can be determined by measuring the oxidation of the hyaluronidase by RP-HPLC. Percent oxidation is a measure of sum of the peak areas of the major (ox-1) and minor (ox-2) peaks.

In one example, the melting temperature of a PH20 polypeptide, such as a modified PH20 polypeptide, can be determined by measuring the hydrodynamic radius of particles by dynamic light scattering under various conditions (e.g., denaturation conditions or other storage conditions). An increase in particle size and a decrease in the melting temperature indicates denaturation and subsequent aggregation of the hyaluronidase.

Other methods known to one of skill in the art that can be used to determine the stability of the hyaluronidase in the co-formulations provided herein, include polyacrylamide gel electrophoresis (PAGE), immunoblotting, nuclear magnetic resonance (NMR) spectroscopy, mass spectrometry, circular dichroism (CD) and dye-based fluorescence assays.

4. Pharmacodynamics/Pharmacokinetics

The effect of administration of a PH20 polypeptide, such as a modified PH20 polypeptide, alone or in combination with another therapeutic agent, on the pharmacokinetic and pharmacodynamic properties of any administered agent also can be assessed in vivo using animal models and/or human subjects, such as in the setting of a clinical trial. Pharmacokinetic or pharmacodynamic studies can be performed using animal models or can be performed during studies with patients administered with a PH20 polypeptide or modified PH20 polypeptide.

Animal models include, but are not limited to, mice, rats, rabbits, dogs, guinea pigs and non-human primate models, such as cynomolgus monkeys or rhesus macaques. In some instances, pharmacokinetic or pharmacodynamic studies are performed using healthy animals. In other examples, the studies are performed using animal models of a disease for which therapy with hyaluronan is considered, such as animal models of any hyaluronan-associated disease or disorder, for example a tumor model.

The pharmacokinetic properties of a PH20 polypeptide, such as a modified PH20 polypeptide, can be assessed by measuring such parameters as the maximum (peak) concentration ($C_{max}$), the peak time (i.e., when maximum concentration occurs; $T_{max}$), the minimum concentration (i.e., the minimum concentration between doses; $C_{min}$), the elimination half-life ($T_{1/2}$) and area under the curve (i.e., the area under the curve generated by plotting time versus concentration; AUC), following administration. The absolute bioavailability of the hyaluronidase can be determined by comparing the area under the curve of hyaluronidase following subcutaneous delivery ($AUC_{sc}$) with the AUC of hyaluronidase following intravenous delivery ($AUC_{iv}$). Absolute bioavailability (F), can be calculated using the formula: $F=([AUC]_{sc} \times dose_{sc})/([AUC]_{iv} \times dose_{iv})$. A range of doses and different dosing frequency of dosing can be administered in the pharmacokinetic studies to assess the effect of increasing or decreasing concentrations enzyme, such as modified PH20 polypeptide, in the dose.

H. Methods of Treatment and Combination Therapy

Provided herein are methods and uses of any of the modified PH20 polypeptides provided herein that exhibit hyaluronidase activity based on its ability to degrade glycosaminoglycan(s) such as hyaluronan. Due to such activity, the modified PH20 polypeptides can be used as a spreading factor to increase the delivery and/or bioavailability of subcutaneously administered therapeutic agents. Delivery of any therapeutic agent, including but not limited to, peptides, proteins, small molecule drugs, nucleic acids, or viruses can be facilitated or enhanced by co-administration with a modified PH20 polypeptide provided herein. For example, modified PH20 polypeptides can be used to increase the delivery of therapeutic agents such as antibodies (e.g., monoclonal antibodies), cytokines, Immune Globulin, an Insulin, or coagulation factors, to a desired locus, such as by increasing penetration of chemotherapeutic agents into solid tumors. The modified PH20 polypeptides also can be used to treat a hyaluronan-disease or disorder that is characterized by an excess or accumulation of hyaluronan. For example, modified PH20 polypeptides provided herein can be used to for treating a tumor; for treating glycosaminoglycan accumulation in the brain; for treating a cardiovascular disorder; for treating an ophthalmic disorder; for treating pulmonary disease; for treating cellulite; and/or for treating a proliferative disorder.

Other methods and uses of a modified PH20 polypeptide include any that are known to one of skill in the art. For example, various forms of PH20 hyaluronidases have been prepared and approved for therapeutic use in humans. For example, animal-derived hyaluronidase preparations include Vitrase® (ISTA Pharmaceuticals), a purified ovine testicular hyaluronidase, and Amphadase® (Amphastar Pharmaceuticals), a bovine testicular hyaluronidase. Hylenex® (Halozyme Therapeutics) is a human recombinant hyaluronidase produced by genetically engineered Chinese Hamster Ovary (CHO) cells containing nucleic acid encoding for soluble rHuPH20 (see e.g., U.S. Pat. No. 7,767,429). Approved therapeutic uses for hyaluronidases include use as an adjuvant to increase the absorption and dispersion of other therapeutic agents for hypodermoclysis (subcutaneous fluid administration), and as an adjunct in subcutaneous urography for improving resorption of radiopaque agents. In addition to these indications, hyaluronidases can be used as a therapeutic or cosmetic agent for the treatment of additional diseases and conditions. For example, hyaluronidase is commonly used, for example, for peribulbar block in local anesthesia prior ophthalmic surgery. The presence of the enzyme prevents the need for additional blocks and reduces the time to the onset of akinesia (loss of eye movement). Peribulbar and sub-Tenon's block are the most common applications of hyaluronidase for ophthalmic procedures. Hyaluronidase also can promote akinesia in cosmetic surgery, such as blepharoplasties and face lifts. It is understood that soluble PH20 hyaluronidases provided herein, including esPH20 hyaluronidases, can be used in any method of treatment or combination therapy for which a PH20 hyaluronidase is used (see e.g., U.S. Publication Nos. US20040268425; US20050260186; US20060104968; and U.S. application Ser. No. 12/381,844, published as U.S. Publication No. US20100074885; Ser. No. 12/386,249, published as U.S. Publication No. US20090311237; Ser. No. 12/387,225, published as U.S. Publication No. US20090304665; and Ser. No. 12/386,222, published as U.S. Publication No. US2010003238, each incorporated by reference in their entirely).

Exemplary, non-limiting, methods and uses are described in the following subsections.

1. Methods of Delivering Therapeutic Agents

As noted above, hyaluronidase is a spreading or diffusing substance that modifies the permeability of connective tissue through the hydrolysis of hyaluronic acid, a polysaccharide found in the intercellular ground substance of connective tissue, and of certain specialized tissues, such as the umbilical cord and vitreous humor. When no spreading factor is present, materials injected subcutaneously, such as drugs, proteins, peptides and nucleic acid, spread very slowly. Co-injection with hyaluronidase, however, can cause rapid spreading. The rate of diffusion is proportional to the amount of enzyme, and the extent of diffusion is proportional to the volume of solution.

Modified PH20 polypeptides provided herein can be used to promote or enhance the delivery agents and molecules to any of a variety of mammalian tissues in vivo. It can be used to facilitate the diffusion and, therefore, promote the delivery, of small molecule pharmacologic agents as well as larger molecule pharmacologic agents, such as proteins, nucleic acids and ribonucleic acids, and macromolecular compositions than can contain a combination of components including, but not limited to, nucleic acids, proteins, carbohydrates, lipids, lipid-based molecules and drugs (see e.g., U.S. Publication Nos. US20040268425; US20050260186; and US20060104968). Modified PH20 polypeptides can be co-administered and/or co-formulated with a therapeutic agent to improve the bioavailability as well as pharmacokinetic (PK) and/or pharmacodynamic (PD) characteristics of co-formulated or co-administered agents. PK/PD parameters that can be improved by using soluble PH20, such as esPH20, include such measures as $C_{max}$ (the maximal concentration of agent achieved following absorption in, e.g., the bloodstream), $T_{max}$ (the time required to achieve maximal concentration), $T_{1/2}$ (the time required for the concentration to fall by half), $C_{min}$ (the minimal concentration of agent following metabolism and excretion), AUC (area under the curve of concentration versus time, a measure of the overall amount of bioavailability), concentrations in various tissues of interest (including, e.g., the rate of achieving desired concentrations, the overall levels, and the duration of maintaining desired levels), and $E_{max}$ (the maximal effect achieved).

The methods of treatment provided herein include combination therapies with a therapeutic agent for the treatment of a disease or disorder for which the therapeutic agent threats. Any therapeutic agent that ameliorates and or otherwise lessens the severity of a disease or condition can be combined with a modified PH20 polypeptide provided herein in order to increase the bioavailability of such therapeutic agent. In particular, modified PH20 polypeptides provided herein can be used in each and all of the combinations described in applications see e.g., U.S. Publication Nos. US20040268425; US20050260186; US20060104968 and U.S. application Ser. No. 12/381,844, published as U.S. Publication No. US20100074885; Ser. No. 12/386,249, published as U.S. Publication No. US20090311237; Ser. No. 12/387,225, published as U.S. Publication No. US20090304665; and Ser. No. 12/386,222, published as U.S. Publication No. US2010003238 in place of the disclosed hyaluronidase or hyaluronidase degrading enzyme.

Modified PH20 polypeptides can be administered prior to, subsequent to, intermittently with or simultaneously with the therapeutic agent preparation. Generally, the modified PH20 polypeptide is administered prior to or simultaneously with administration of the therapeutic agent preparation to permit the PH20 to degrade the hyaluronic acid in the interstitial space. The PH20 can be administered at a site different from the site of administration of the therapeutic molecule or the soluble PH20 can be administered at a site the same as the site of administration of the therapeutic molecule.

Examples of pharmaceutical, therapeutic and cosmetic agents and molecules that can be administered with hyaluronidase include, but are not limited to, a chemotherapeutic or anticancer agent, an analgesic agent, an antibiotic agent, an anti-inflammatory agent, an antimicrobial agent, an amoebicidal agent, a trichomonacidal agent, an antiparkinson agent, an anti-malarial agent, an anticonvulsant agent, an anti-depressant agent, an anti-arthritic agent, an anti-fungal agent, an antihypertensive agent, an antipyretic agent, an anti-parasitic agent, an antihistamine agent, an alpha-adrenergic agonist agent, an alpha blocker agent, an anesthetic agent, a bronchial dilator agent, a biocide agent, a bactericide agent, a bacteriostatic agent, a beta adrenergic blocker agent, a calcium channel blocker agent, a cardiovascular drug agent, a contraceptive agent, a cosmetic or esthetic agent, a decongestant agent, a diuretic agent, a depressant agent, a diagnostic agent, an electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sleep inducer, a sympathomimetic agent, a tranquilizer agent, a urinary agent, a vaginal agent, a viricide agent, a vitamin agent, a non-steroidal anti-inflammatory agent, or an angiotensin converting enzyme inhibitor agent, and any combination thereof. In particular, therapeutic agents include antibodies, including monoclonal antibodies, bisphosphonates, insulins, coagulation factors, cytokines and Immun Globulins.

For example, modified PH20 polypeptides provided herein can be used to increase the delivery of chemotherapeutic agents. Hyaluronidases have also been used to enhance the activity of chemotherapeutics and/or the accessibility of tumors to chemotherapeutics (Schuller et al., 1991, *Proc. Amer. Assoc. Cancer Res.* 32:173, abstract no. 1034; Czejka et al., 1990, *Pharmazie* 45:H9; Baumgartner et al. (1988) *Reg. Cancer Treat.* 1:55-58; Zanker et al. (1986) *Proc. Amer. Assoc. Cancer Res.* 27:390). Combination chemotherapy with hyaluronidase is effective in the treatment of a variety of cancers including urinary bladder cancer (Horn et al.; 1985, *J. Surg. Oncol.* 28:304-307), squamous cell carcinoma (Kohno et al., 94, *J. Cancer Res. Oncol.* 120: 293-297), breast cancer (Beckenlehner et al., 1992, *J. Cancer Res. Oncol.* 118:591-596), and gastrointestinal cancer (Scheithauer et al., 1988, *Anticancer Res.* 8:391-396). In this example, the modified PH20 hyaluronidase enhances penetration of chemotherapeutic or other anti-cancer agents into solid tumors, thereby treating the disease.

Compositions containing soluble PH20 can be injected intratumorally with anti-cancer agents or intravenously for disseminated cancers or hard to reach tumors. The anticancer agent can be a chemotherapeutic, an antibody, a peptide, or a gene therapy vector, virus or DNA. Additionally, hyaluronidase can be used to recruit tumor cells into the cycling pool for sensitization in previously chemorefractory tumors that have acquired multiple drug resistance (St Croix et al., (1998) *Cancer Lett* September 131(1): 35-44).

Exemplary anti-cancer agents that can be administered after, coincident with or before administration of a soluble PH20, such as an esPH20, include, but are not limited to Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Ciplactin; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonas; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Lnterleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprolides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; Melphalan L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patupilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycin Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars, for example:

Aldesleukins (e.g., PROLEUKIN®); Alemtuzumabs (e.g., CAMPATH®); Alitretinoins (e.g., PANRETIN®); Allopurinols (e.g., ZYLOPRIM®); Altretamines (e.g., HEXALEN®); Amifostines (e.g., ETHYOL®); Anastrozoles (e.g., ARIMIDEX®); Arsenic Trioxides (e.g., TRISENOX®); Asparaginases (e.g., ELSPAR®); BCG Live (e.g., TICE®BCG); Bexarotenes (e.g., TARGRETIN®); Bevacizumab (AVASTDM®); Bleomycins (e.g., BLENOXANE®); Busulfan intravenous (e.g., BUSULFEX®); Busulfan orals (e.g., MYLERAN™); Calusterones (e.g., METHOSARB®); Capecitabines (e.g., XELODA®); Carboplatins (e.g., PARAPLATIN®); Carmustines (e.g., BCNU®, BiCNU®); Carmustines with Polifeprosans (e.g., GLIADEL® Wafer); Celecoxibs (e.g., CELEBREX®); Chlorambucils (e.g., LEUKERAN®); Cisplatins (e.g., PLATINOL®); Cladribines (e.g., LEU STATIN®, 2-CdA®); Cyclophosphamides (e.g., CYTOXAN®, NEOSAR®); Cytarabines (e.g., CYTOSAR-U®); Cytarabine liposomals (e.g., DepoCyt®); Dacarbazines (e.g., DTIC-Dometi): Dactinomycins (e.g., COSMEGEN®); Darbepoetin Alfas (e.g., ARANESP®); Daunorubicin liposomals (e.g. DAUNOXOME®); Daunorubicins/Daunomycins (e.g., CERUBIDINE®); Denileukin Diftitoxes (e.g., ONTAK®); Dexrazoxanes (e.g., ZINECARD®); Docetaxels (e.g., TAXOTERE®); Doxorubicins (e.g., ADRIAMYCIN®, RUBEX®); Doxorubicin liposomals, including Doxorubicin HCL liposome injections (e.g., DOXIL®); Dromostanolone propionates (e.g., DROMOSTANOLONE® and MASTERONE® Injection); Elliott's B Solutions (e.g., Elliott's B Solution®); Epirubicins (e.g., ELLENCE®); Epoetin alfas (e.g., EPOGEN®); Estramustines (e.g., EMCYT®); Etoposide phosphates (e.g., ETOPOPHOS®); Etoposide VP-16s (e.g., VEPESID®); Exemestanes (e.g., AROMASIN®); Filgrastims (e.g., NEUPOGEN®); Floxuridines (e.g., FUDR®); Fludarabines (e.g., FLUDARA®); Fluorouracils incl. 5-FUs (e.g., ADRUCIL®); Fulvestrants (e.g., FASLODEX®); Gemcitabines (e.g., GEMZAR®); Gemtuzumabs/Ozogamicins (e.g., MYLOTARG®); Goserelin acetates (e.g., ZOLADEX®); Hydroxyureas (e.g., HYDREA®); Ibritumomabs/Tiuxetans (e.g., ZEVALIN®); Idarubicins (e.g., IDAMYCIN®); Ifosfamides (e.g., IFEX®); Imatinib mesylates (e.g., GLEEVEC®); Interferon alfa-2 as (e.g., ROFERON-A®); Interferon alfa-2bs (e.g., INTRON A®); Irinotecans (e.g., CAMPTOSAR®); Letrozoles (e.g., FEMARA®); Leucovorins (e.g., WELLCOVORIN®, LEUCOVORIN®); Levamisoles (e.g., ERGAMISOL®); Lomustines/CCNUs (e.g., CeeNU®); Mechlorethamines/Nitrogen mustards (e.g., MUSTARGEN®); Megestrol acetates (e.g., MEGACE®); Melphalans/L-PAMs (e.g., ALKERAN®); Mercaptopurine incl. 6-MPs (e.g., PURINETHOL®); Mesnas (e.g., MESNEX®); Methotrexates; Methoxsalens (e.g., UVADEX®); Mitomycin Cs (e.g., MUTAMYCIN®, MITOZYTREX®); Mitotanes (e.g., LYSODREN®); Mitoxantrones (e.g., NOVANTRONE®); Nandrolone Phenpropionates (e.g., DURABOLIN-50®); Nofetumomabs (e.g., VERLUMA®); Oprelvekins (e.g., NEUMEGA®); Oxaliplatins (e.g., ELOXATIN®); Paclitaxels (e.g., PAXENE®, TAXOL®); Pamidronates (e.g., AREDIA®); Pegademases (e.g., ADAGEN®); Pegaspargases (e.g., ONCASPAR®); Pegfilgrastims (e.g., NEULASTA®); Pentostatins (e.g., NIPENT®); Pipobromans (e.g., VERCYTE®); Plicamycin/Mithramycins (e.g., MITHRACIN®); Porfimer sodiums (e.g., PHOTOFRTN®); Procarbazines (e.g., MATULANE®); Quinacrines (e.g., ATABRTNE®); Rasburicases (e.g., ELITEK®); Rituximabs (e.g., RITUXAN®); Sargramostims (e.g., PROKINE®); Streptozocins (e.g., ZANOSAR®); Sunitinib Malates (e.g., SUTENT®); Talcs (e.g., SCLEROSOL®); Tamoxifens (e.g., NOLVADEX®); Temozolomides (e.g., TEMODAR®); Teniposides/VM-26s (e.g., VUMON®); Testolactones (e.g., TESLAC®); Thioguanines incl. 6-TG; Thiotepas (e.g., THIOPLEX®); Topotecans (e.g., HYCAMTEN®); Toremifenes (e.g., FARESTON®); Tositumomabs (e.g., BEXXAR®); Trastuzumabs (e.g., HERCEPTIN®); Tretinoins/ATRA (e.g., VESANOID®); Uracil Mustards; Valrubicins (e.g., VALSTAR®); Vinblastines (e.g., VELBAN®); Vincristines (e.g., ONCOVIN®); Vinorelbines (e.g., NAVELBINE®); and Zoledronates (e.g., ZOMETA®).

For example, exemplary antibiotic agents include, but are not limited to, Aminoglycosides; Amphenicols; Ansamycins; Carbacephems; Carbapenems; Cephalosporins or Cephems; Cephamycins; Clavams; Cyclic lipopeptides; Diaminopyrimidines; Ketolides; Lincosamides; Macrolides; Monobactams; Nitrofurans; Oxacephems; Oxazolidinones; Penems, thienamycins and miscellaneous beta-lactams; Penicillins; Polypeptides antibiotics; Quinolones; Sulfonamides; Sulfones; Tetracyclines; and other antibiotics (such as Clofoctols, Fusidic acids, Hexedines, Methenamines, Nitrofurantoins Nitroxolines, Ritipenems, Taurolidines, Xibomols).

Also included among exemplary therapeutic agents are coagulation factors or other blood modifiers such as antihemophilic factors, anti-inhibitor coagulant complexes, anti-thrombin III, coagulation Factor V, coagulation Factor VIII, coagulation Factor IX, plasma protein fractions, von Willebrand factors; antiplatelet agents (including, for example, abciximabs, anagrelides, cilostazols, clopidogrel bisulfates, dipyridamoles, epoprostenols, eptifibatides, tirofibans; colony stimulating factors (CSFs) (including, for example, Granulocyte CSFs and Granulocyte Macrophage CSFs); erythropoiesis stimulators (including, for example, erythropoietins such as darbepoetin alfas) and epoetin alfas; hemostatics and albumins (including, for example, aprotinins, combinations of antihemophilic factors and plasma, Desmopressin Acetates, and albumins); immune globulins, as well as hepatitis B immune globulins; thrombin inhibitors (including for example direct thrombin inhibitors and lepirudin), and drotrecogin alfas; anticoagulants (including, for example, dalteparins, enoxaparins and other heparins, and warfarins).

Exemplary antibodies or other therapeutic agents include, but are not limited to, Cetuximab (IMC-C225; Erbitux®); Trastuzumab (Herceptin®); Rituximab (Rituxan®; MabThera®); Bevacizumab (Avastin®); Alemtuzumab (Campath®; Campath-1H®; Mabcampath®); Panitumumab (ABX-EGF; Vectibix®); Ranibizumab (Lucentis®); Ibritumomab; Ibritumomab tiuxetan (Zevalin®); Tositumomab; Iodine I 131 Tositumomab (BEXXAR®); Catumaxomab (Removab®); Gemtuzumab; Gemtuzumab ozogamicin (Mylotarg®); Abatacept (CTLA4-Ig; Orencia®); Belatacept (L104EA29YIg; LEA29Y; LEA); Ipilimumab (MDX-010; MDX-101); Tremelimumab (ticilimumab; CP-675,206); PRS-010 (see e.g., US20090042785); PRS-050 (US7585940; US20090305982); Aflibercept (VEGF Trap, AVE005; Holash et al., (2002) *PNAS* 99:11393-11398); Volociximab (M200); F200 (Chimeric (human/murine) IgG4 Fab fragment of Volociximab (M200)); MORAb-009 Mouse/human chimeric IgG1 (US20050054048); Soluble fusion protein: Anti-mesothelin Fv linked to atruncated *Pseudomonas* exotoxin A (SS1P (CAT-5001); US20070189962); Cixutumumab (DVIC-A12); Nimotuzumab (h-R3) (Spicer (2005) *Curr Opin Mol Ther* 7:182-191); Zalutumumab (HuMax-EGFR; Lammerts van Bueren et al. (2008) *PNAS* 105:6109-14); Necitumumab IMC-11F8 (Li et al. (2008) *Structure* 16:216-227); Sym004 (Pedersen et al. 2010 *Cancer Res* 70:588-597); and mAb-425.

In particular, therapeutic agents include, but are not limited to, immunoglobulins, Interferon beta, Interferon alpha-2 as, Interferon alpha-1s, Interferon alpha-n3s, Interferon beta-1, Interferon beta-1as, Interferon gamma-1bs, Peg-interferon alpha-2 and Peginterferon alpha-2bs, insulin, a bisphosphate (e.g., Pamidronates or Zoledronates), Docetaxels, Doxorubicins, Doxorubicin liposomals and bevacizumabs.

Other exemplary therapeutic agents that can be combined by co-administration and/or co-formulation with a modified PH20 polypeptide provided herein, include, but are not limited to, Adalimumabs, Agalsidase Betas, Alefacepts, Ampicillins, Anakinras, Antipoliomyelitic Vaccines, Anti-Thymocytes, Azithromycins, Becaplermins, Caspofungins, Cefazolins, Cefepimes, Cefotetans, Ceftazidimes, Ceftriaxones, Cetuximabs, Cilastatins, Clavulanic Acids, Clindamycins, Darbepoetin Alfas, Daclizumabs, Diphtheria, Diphtheria antitoxins, Diphtheria Toxoids, Efalizumabs, Epinephrines, Erythropoietin Alphas, Etanercepts, Filgrastims, Fluconazoles, Follicle-Stimulating Hormones, Follitropin Alphas, Follitropin Betas, Fosphenyloins, Gadodiamides, Gadopentetates, Gatifloxacins, Glatiramers, GM-CSF's, Goserelins, Goserelin acetates, Granisetrons, *Haemophilus Influenza* B's, Haloperidols, Hepatitis vaccines, Hepatitis A Vaccines, Hepatitis B Vaccines, Ibritumomab Tiuxetans, Ibritumomabs, Tiuxetans, Immunoglobulins, *Hemophilus influenza* vaccines, Influenza Virus Vaccines, Infliximabs, Insulins, Insulin Glargines, Interferons, Interferon alphas, Interferon Betas, Interferon Gammas, Interferon alpha-2a's, Interferon alpha-2b's, Interferon alpha-1's, Interferon alpha-n3's, Interferon Betas, Interferon Beta-1a's, Interferon Gammas, Interferon alpha-consensus, Iodixanols, Iohexyls, Iopamidols, Ioversols, Ketorolacs, Laronidases, Levofloxacins, Lidocaines, Linezolids, Lorazepams, Measles Vaccines, Measles virus, Mumps viruses, Measles-Mumps-Rubella Virus Vaccines, Rubella vaccines, Medroxyprogesterones, Meropenems, Methylprednisolones, Midazolams, Morphines, Octreotides, Omalizumabs, Ondansetrons, Palivizumabs, Pantoprazoles, Pegaspargases, Pegfilgrastims, Peg-Interferon Alfa-2a's, Peg-Interferon Alfa-2b's, Pegvisomants, Pertussis vaccines, Piperacillins, Pneumococcal Vaccines and Pneumococcal Conjugate Vaccines, Promethazines, Reteplases, Somatropins, Sulbactams, Sumatriptans, Tazobactams, Tenecteplases, Tetanus Purified Toxoids, Ticarcillins, Tositumomabs, Triamcinolones, Triamcinolone Acetonides, Triamcinolone hexacetonides, Vancomycins, Varicella Zoster immunoglobulins, Varicella vaccines, other vaccines, Alemtuzumabs, Alitretinoins, Allopurinols, Altretamines, Amifostines, Anastrozoles, Arsenics, Arsenic Trioxides, Asparaginases, *Bacillus* Calmette-Guerin (BCG) vaccines, BCG Live, Bexarotenes, Bleomycins, Busulfans, Busulfan intravenous, Busulfan orals, Calusterones, Capecitabines, Carboplatins, Carmustines, Carmustines with Polifeprosans, Celecoxibs, Chlorambucils, Cisplatins, Cladribines, Cyclophosphamides, Cytarabines, Cytarabine liposomals, Dacarbazines, Dactinomycins, Daunorubicin liposomals, Daunorubicins, Daunomycins, Denileukin Diftitoxes, Dexrazoxanes, Docetaxels, Doxorubicins, Doxorubicin liposomals, Dromostanolone propionates, Elliott's B Solutions, Epirubicins, Epoetin alfas, Estramustines, Etoposides, Etoposide phosphates, Etoposide VP-16s, Exemestanes, Floxuridines, Fludarabines, Fluorouracils, 5-Fluorouracils, Fulvestrants, Gemcitabines, Gemtuzumabs, Ozogamicins, Gemtuzumab ozogamicins, Hydroxyureas, Idarubicins, Ifosfamides, Imatinib mesylates, Irinotecans, Letrozoles, Leucovorins, Levamisoles, Lomustines, CCNUs, Mechlorethamines, Nitrogen mustards, Megestrols, Megestrol acetates, Melphalans, L-PAMs, Mercaptopurines, 6-Mercaptopurines, Mesnas, Methotrexates, Methoxsalens, Mitomycins, Mitomycin C's, Mitotanes, Mitoxantrones, Nandrolones, Nandrolone Phenpropionates, Nofetumomabs, Oprelvekins, Oxaliplatins, Paclitaxels, Pamidronates, Pegademases, Pentostatins, Pipobromans, Plicamycins, Mithramycins, Porfimers, Porfimer sodiums, Procarbazines, Quinacrines, Rasburicases, Rituximabs, Sargramostims, Streptozocins, Talcs, Tamoxifens, Temozolomides, Teniposides, Testolactones, Thioguanines, 6-Thioguanines, Triethylenethiophosphoramides (Thiotepas), Topotecans, Toremifenes, Trastuzumabs, Tretinoins, Uracil Mustards, Valrubicins, Vinblastines, Vincristines, Vinorelbines, Zoledronates, Acivicins, Aclarubicins, Acodazoles, Acronines, Adozelesins, Aldesleukins, Retinoic Acids, Alitretinoins, 9-Cis-Retinoic Acids, Alvocidibs, Ambazones, Ambomycins, Ametantrones, Aminoglutethimides, Amsacrines, Anaxirones, Ancitabines, Anthramycins, Apaziquones, Argimesnas, Asperlins, Atrimustines, Azacitidines, Azetepas, Azotomycins, Banoxantrones, Batabulins, Batimastats, Benaxibines, Bendamustines, Benzodepas, Bicalutamides, Bietaserpines, Biricodars, Bisantrenes, Bisnafide Dimesylates, Bizelesins, Bortezomibs, Brequinars, Bropirimines, Budotitanes, Cactinomycins, Canertinibs, Caracemides, Carbetimers, Carboquones, Carmofurs, Carubicins, Carzelesins, Cedefingols, Cemadotins, Chlorambucils, Cioteronels, Cirolemycins, Clanfenurs, Clofarabines, Crisnatols, Decitabines, Dexniguldipines, Dexormaplatins, Dezaguanines, Diaziquones, Dibrospidiums, Dienogests, Dinalins, Disermolides, Dofequidars, Doxifluridines, Droloxifenes, Duazomycins, Ecomustines, Edatrexates, Edotecarins, Eflornithines, Elacridars, Elinafides, Elsamitrucins, Emitefurs, Enloplatins, Enpromates, Enzastaurins, Epipropidines, Eptaloprosts, Erbulozoles, Esorubicins, Etanidazoles, Etoglucids, Etoprines, Exisulinds, Fadrozoles, Fazarabines, Fenretinides, Fluoxymesterones, Fluorocitabines, Fosquidones, Fostriecins, Fotretamines, Galarubicins, Galocitabines, Geroquinols, Gimatecans, Gimeracils, Gloxazones, Glufosfamides, Ilmofosines, Ilomastats, Imexons, Improsulfans, Indisulams, Inproquones, Interleukins, Interleukin-2s, recombinant Interleukins, Intoplicines, Iobenguanes, Iproplatins, Irsogladines, Ixabepilones, Ketotrexates, L-Alanosines, Lanreotides, Lapatinibs, Ledoxantrones, Leuprolides, Leuprorelins, Lexacalcitols, Liarozoles, Lobaplatins, Lometrexols, Lonafarnibs, Losoxantrones, Lurtotecans, Mafosfamides, Mannosulfans, Marimastats, Masoprocols, Maytansines, Mechlorethamines, Melengestrols, Melphalans, Menogarils, Mepitiostanes, Metesinds, Metomidates, Metoprines, Meturedepas, Miboplatins, Miproxifenes, Misonidazoles, Mitindomides, Mitocarcins, Mitocromins, Mitoflaxones, Mitogillins, Mitoguazones, Mitomalcins, Mitonafides, Mitoquidones, Mitospers, Mitozolomides, Mivobulins, Mizoribines, Mofarotenes, Mopidamols, Mubritinibs, Mycophenolic Acids, Nedaplatins, Neizarabines, Nemorubicins, Nitracrines, Nocodazoles, Nogalamycins, Nolatrexeds, Nortopixantrones, Ormaplatins, Ortataxels, Oteracils, Oxisurans, Oxophenarsines, Patupilones, Peldesines, Peliomycins, Pelitrexols, Pemetrexeds, Pentamustines, Peplomycins, Perfosfamides, Perifosines, Picoplatins, Pinafides, Piposulfans, Pirfenidones, Piroxantrones, Pixantrones, Plevitrexeds, Plomestanes, Porfiromycins, Prednimustines, Propamidines, Prospidiums, Pumitepas, Puromycins, Pyrazofurins, Ranimustines, Riboprines, Ritrosulfans, Rogletimides, Roquinimexs, Rufocromomycins, Sabarubicins, Safingols, Satraplatins, Sebriplatins, Semustines, Simtrazenes, Sizofirans, Sobuzoxanes, Sorafenibs, Sparfosates, Sparfosic Acids, Sparsomycins, Spirogermaniums, Spiromustines, Spiroplatins, Squalamines, Streptonigrins, Streptovarycins, Sufosfamides, Sulofenurs, Tacedinalines, Talisomycins, Tallimustines, Tariquidars, Tauromustines, Tecogalans, Tegafurs, Teloxantrones, Temoporfins, Teroxirones, Thiamiprines, Tiamiprines, Tiazofurins, Tilomisoles, Tilorones, Timcodars, Timonacics, Tirapazamines, Topixantrones, Trabectedins, Ecteinascidin 743, Trestolones, Triciribines, Trilostanes, Trimetrexates, Triplatin Tetranitrates, Triptorelins, Trofosfamides, Tubulozoles, Ubenimexs, Uredepas, Valspodars, Vapreotides, Verteporfins, Vinblastines, Vindesines, Vinepidines, Vinflunines, Vinformides, Vinglycinates, Vinleucinols, Vinleurosines, Vinrosidines, Vintriptols, Vinzolidines, Vorozoles, Xanthomycin A's, Guamecyclines, Zeniplatins, Zilascorbs [2-H], Zinostatins, Zorubicins, Zosuquidars, Acetazolamides, Acyclovirs, Adipiodones, Alatrofloxacins, Alfentanils, Allergenic extracts, Alpha 1-proteinase inhibitors, Alprostadils, Amikacins, Amino acids, Aminocaproic acids, Aminophyllines, Amitriptylines, Amobarbitals, Amrinones, Analgesics, Anti-poliomyelitic vaccines, Anti-rabic serums, Anti-tetanus immunoglobulins, tetanus vaccines, Antithrombin IIIs, Antivenom serums, Argatrobans, Arginines, Ascorbic acids, Atenolols, Atracuriums, Atropines, Aurothioglucoses, Azathioprines, Aztreonams, Bacitracins, Baclofens, Basiliximabs, Benzoic acids, Benztropines, Betamethasones, Biotins, Bivalirudins, Botulism antitoxins, Bretyliums, Bumetanides, Bupivacaines, Buprenorphines, Butorphanols, Calcitonins, Calcitriols, Calciums, Capreomycins, Carboprosts, Carnitines, Cefamandoles, Cefoperazones, Cefotaximes, Cefoxitins, Ceftizoximes, Cefuroximes, Chloramphenicols, Chloroprocaines, Chloroquines, Chlorothiazides, Chlorpromazines, Chondroitinsulfuric acids, Choriogonadotropin alfas, Chromiums, Cidofovirs, Cimetidines, Ciprofloxacins, Cisatracuriums, Clonidines, Codeines, Colchicines, Colistins, Collagens, Corticorelin ovine triflutates, Corticotrophins, Cosyntropins, Cyanocobalamins, Cyclosporines, Cysteines, Dacliximabs, Dalfopristins, Dalteparins, Danaparoids, Dantrolenes, Deferoxamines, Desmopressins, Dexamethasones, Dexmedetomidines, Dexpanthenols, Dextrans, Iron dextrans, Diatrizoic acids, Diazepams, Diazoxides, Dicyclomines, Digibinds, Digoxins, Dihydroergotamines, Diltiazems, Diphenhydramines, Dipyridamoles, Dobutamines, Dopamines, Doxacuriums, Doxaprams, Doxercalciferols, Doxycyclines, Droperidols, Dyphyllines, Edetic acids, Edrophoniums, Enalaprilats, Ephedrines, Epoprostenols, Ergocalciferols, Ergonovines, Ertapenems, Erythromycins, Esmolols, Estradiols, Estrogenics, Ethacrynic acids, Ethanolamines, Ethanols, Ethiodized oils, Etidronic acids, Etomidates, Factor VIIIs, Famotidines, Fenoldopams, Fentanyls, Flumazenils, Fluoresceins, Fluphenazines, Folic acids, Fomepizoles, Fomivirsens, Fondaparinuxs, Foscarnets, Fosphenyloins, Furosemides, Gadoteridols, Gadoversetamides, Ganciclovirs, Gentamicins, Glucagons, Glucoses, Glycines, Glycopyrrolates, Gonadorelins, Gonadotropin chorionics, *Haemophilus* B polysaccharides, Hemins, Herbals, Histamines, Hydralazines, Hydrocortisones, Hydromorphones, Hydroxocobalamins, Hydroxyzines, Hyoscyamines, Ibutilides, Imiglucerases, Indigo carmines, Indomethacins, Iodides, Iopromides, Iothalamic acids, Ioxaglic acids, Ioxilans, Isoniazids, Isoproterenols, Japanese encephalitis vaccines, Kanamycins, Ketamines, Labetalols, Lepirudins, Levobupivacaines, Levothyroxines, Lincomycins, Liothyronines, Luteinizing hormones, Lyme disease vaccines, Mangafodipirs, Manthtols, Meningococcal polysaccharide vaccines, Meperidines, Mepivacaines, Mesoridazines, Metaraminols, Methadones, Methocarbamols, Methohexitals, Methyldopates, Methylergonovines, Metoclopramides, Metoprolols, Metronidazoles, Minocyclines, Mivacuriums, Morrhuic acids, Moxifloxacins, Muromonab-CD3s, Mycophenolate mofetils, Nafcillins, Nalbuphines, Nalmefenes, Naloxones, Neostigmines, Niacinamides, Nicardipines, Nitroglycerins, Nitroprussides, Norepinephrines, Orphenadrines, Oxacillins, Oxymorphones, Oxytetracyclines, Oxytocins, Pancuroniums, Panthenols, Pantothenic acids, Papaverines, Peginterferon-alpha (e.g., interferon alpha 2a or 2b), Penicillin Gs, Pentamidines, Pentazocines, Pentobarbitals, Perflutrens, Perphenazines, Phenobarbitals, Phentolamines, Phenylephrines, Phenyloins, Physostigmines, Phytonadiones, Polymyxin bs, Pralidoximes, Prilocalnes, Procainamides, Procaines, Prochlorperazines, Progesterones, Propranolols, Pyridostigmine hydroxides, Pyridoxines, Quinidines, Quinupristins, Rabies immunoglobulins, Rabies vaccines, Ranitidines, Remifentanils, Riboflavins, Rifampins, Ropivacaines, Samariums, Scopolamines, Seleniums, Sermorelins, Sincalides, Somatrems, Spectinomycins, Streptokinases, Streptomycins, Succinylcholines, Sufentanils, Sulfamethoxazoles, Tacrolimuses, Terbutalines, Teriparatides, Testosterones, Tetanus antitoxins, Tetracaines, Tetradecyl sulfates, Theophyllines, Thiamines, Thiethylperazines, Thiopentals, Thyroid stimulating hormones, Tinzaparins, Tirofibans, Tobramycins, Tolazolines, Tolbutamides, Torsemides, Tranexamic acids, Treprostinils, Trifluoperazines, Trimethobenzamides, Trimethoprims, Tromethamines, Tuberculins, Typhoid vaccines, Urofollitropins, Urokinases, Valproic acids, Vasopressins, Vecuroniums, Verapamils, Voriconazoles, Warfarins, Yellow fever vaccines, Zidovudines, Zincs, Ziprasidone hydrochlorides, Aclacinomycins, Actinomycins, Adriamycins, Azaserines, 6-Azauridines, Carzinophilins, Chromomycins, Denopterins, 6-Diazo-5-Oxo-L-Norleucines, Enocitabines, Floxuridines, Olivomycins, Pirarubicins, Piritrexims, Pteropterins, Tegafurs, Tubercidins, Alteplases, Arcitumomabs, bevacizumabs, Botulinum Toxin Type A's, Botulinum Toxin Type B's, Capromab Pendetides, Daclizumabs, Dornase alfas, Drotrecogin alfas, Imciromab Pentetates, and Iodine-131's.

Delivery of Insulin

Methods provided herein include methods of co-administering a modified PH20 polypeptide and an insulin to increase subcutaneous delivery of the insulin, such as a fast-acting insulin (see e.g., U.S. Pat. No. 7,767,429; U.S. Pat. No. 7,846,431; U.S. Publication No. US20090304665; and U.S. application Ser. Nos. 13/507,263; 13/507,262 and 13/507,261). Such methods include methods of direct administration, and pump and continuous infusion methods, including open and closed pump systems. For example, exemplary insulins that can be administered with a modified PH20 hyaluronidase provided herein are fast-acting insulins or insulin analogs. For example, a co-administered insulin includes a regular insulin, insulin aspart, insulin lispro, insulin glulisine or other similar analog variants. Exemplary insulins are insulins that contain an A chain set forth in SEQ ID NO:862 and a B chain set forth in SEQ ID NO:863 or variants that contain one or more amino acid modifications compared to a human insulin set forth in SEQ ID NO: 862 and 863 (A and B chains). For example, exemplary insulin analogs are known to one of skill in the art, and include, but are not limited to, those set forth in SEQ ID NOS:862 (A-chain) and having a B-chain set forth in any of SEQ ID NOS: 865-867.

The co-formulations can be administered subcutaneously to treat any condition that is amenable to treatment with insulin. Therapeutic uses include, but are not limited to, treatment for type 1 diabetes mellitus, type 2 diabetes mellitus, gestational diabetes, and for glycemic control in critically ill patients. For example, the co-formulations of a fast acting insulin and hyaluronan degrading enzyme can be administered subcutaneously in discrete doses, such as via a syringe or insulin pen, prior to a meal as prandial insulin therapy in subjects with diabetes to achieve glycemic control. The co-formulations also can be administered subcutaneously or intraperitoneally using an insulin pump or in the context of a closed loop system to continuously control blood glucose levels throughout the day and night and/or to control post-prandial glycemic excursions. It is within the skill of a treating physician to identify such diseases or conditions.

For any disease or condition, including all those exemplified above, for which a fast-acting insulin is indicated or has been used and for which other agents and treatments are available, the co-formulations can be used in combination therewith. Depending on the disease or condition to be treated, exemplary combinations include, but are not limited to, combinations with anti-diabetic drugs, including, but not limited to, sulfonylureas, biguanides, meglitinides, thiazolidinediones, alpha-glucosidase inhibitors, peptide analogs, including glucagon-like peptide (GLP) analogs and, gastric inhibitory peptide (GIP) analogs and DPP-4 inhibitors. In another example, the co-formulations of a fast acting insulin and modified PH20 polypeptide described herein can be administered in combination with, prior to, intermittently with, or subsequent to, one or more other insulins, including fast-acting insulin, and basal-acting insulins.

2. Methods of Hyaluronan-Associated Diseases and Conditions (e.g., Tumors)

In particular, PH20 hyaluronidase can be used to treat hyaluronan-associated diseases or conditions. Typically, hyaluronan-associated diseases and conditions are associated with elevated hyaluronan expression in a tissue, cell, or body fluid (e.g., tumor tissue or tumor-associated tissue, blood, or interstitial space) compared to a control, e.g., another tissue, cell or body fluid. The elevated hyaluronan expression can be elevated compared to a normal tissue, cell or body fluid, for example, a tissue, cell or body fluid that is analogous to the sample being tested, but isolated from a different subject, such as a subject that is normal (i.e., does not have a disease or condition, or does not have the type of disease or condition that the subject being tested has), for example, a subject that does not have a hyaluronan-associated disease or condition. The elevated hyaluronan expression can be elevated compared to an analogous tissue from another subject that has a similar disease or condition, but whose disease is not as severe and/or is not hyaluronan-associated or expresses relatively less hyaluronan and thus is hyaluronan-associated to a lesser degree. For example, the subject being tested can be a subject with a hyaluronan-associated cancer, where the HA amounts in the tissue, cell or fluid are relatively elevated compared to a subject having a less severe cancer, such as an early stage, differentiated or other type of cancer. In another example, the cell, tissue or fluid contains elevated levels of hyaluronan compared to a control sample, such as a fluid, tissue, extract (e.g., cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines.

Hyaluronan-associated diseases and conditions include those associated with high interstitial fluid pressure, such as disc pressure, proliferative disorders, such as cancer and benign prostatic hyperplasia, and edema. Edema can result from or be manifested in, for example, organ transplant, stroke or brain trauma. Proliferative disorders include, but are not limited to, cancer, smooth muscle cell proliferation, systemic sclerosis, cirrhosis of the liver, adult respiratory distress syndrome, idiopathic cardiomyopathy, lupus erythematosus, retinopathy, e.g., diabetic retinopathy or other retinopathies, cardiac hyperplasia, reproductive system associated disorders, such as benign prostatic hyperplasia (BPH) and ovarian cysts, pulmonary fibrosis, endometriosis, fibromatosis, hamartomas, lymphangiomatosis, sarcoidosis, desmoid tumors. Cancers include solid and lymphatic/blood tumors and metastatic disease, and undifferentiated tumors. The tumors amenable to treatment typically exhibit cellular and/or stromal expression of a hyaluronan, compared to a non-cancerous tissue of the same tissue type or compared to a non-metastatic tumor of the same tumor-type. Cancers include any one or more of ovarian cancer, in situ carcinoma (ISC), squamous cell carcinoma (SCC), prostate cancer, pancreatic cancer, other gastric cancers, non-small cell lung cancer, breast cancer, brain cancer and colon cancer.

Modified PH20 polypeptides provided herein, such as PEGylated forms thereof, can be used to treat tumors. Thus, in addition to its indirect anticancer effects, hyaluronidases also have direct anticarcinogenic effects. Hyaluronidase prevents growth of tumors transplanted into mice (De Maeyer et al., 1992, *Int. J. Cancer* 51:657-660) and inhibits tumor formation upon exposure to carcinogens (Pawlowski et al., 1979, *Int. J. Cancer* 23:105-109; Haberman et al., 1981, Proceedings of the 17th Annual Meeting of the American Society of Clinical Oncology, Washington, D.C., 22:105, abstract no. 415). PH20 hyaluronidase has been shown to treat various tumors (see e.g., U.S. Publication No. US2010/0003238 and U.S. application Ser. No. 13/135,817, published as U.S. Publication No. US20120020951).

The hyaluronan-rich cancer can be a cancer in which the cancer cells produce HALOs, cancers that have elevated expression of hyaluronan (as determined by immunostaining, e.g., histological staining of sections from the tumor), cancers that have elevated HAS2 (Hyaluronan synthase 2), cancers that do not produce hyaluronidase (HYAL1) in vitro. Hyaluronan-rich cancers can be identified by any method for assessing hyaluronan expression, and other known methods for assaying protein/mRNA expression.

Several hyaluronan-rich cancers have been identified. In some cases, hyaluronan expression correlates with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Anttila et al., *Cancer Research*, 60:150-155 (2000); Karvinen et al., *British Journal of Dermatology*, 148:86-94 (2003); Lipponen et al., *Eur. Journal of Cancer*, 849-856 (2001); Pirinen et al., *Int. J. Cancer:* 95:12-17 (2001); Auvinen et al., *American Journal of Pathology*, 156(2):529-536 (2000); Ropponen et al., *Cancer Research*, 58:342-347 (1998)). Thus, hyaluronan-rich cancers can be treated by administration of a hyaluronidase, such as a soluble PH20, to treat one or more symptoms of the cancer. Hyaluronan-rich tumors include, but are not limited to those of the prostate, breast, colon, ovarian, stomach, head and neck and other tumors and cancers.

Other hyaluronan-associated diseases or conditions that are associated with excess glycosaminoglycans and that can be treated with a modified PH20 polypeptide provided herein include, but are not limited to, cardiovascular disease (e.g., following ischemia reperfusion; in arteriosclerosis); vitrectomy and ophthalmic disorders and conditions (e.g., in methods to liquefy the vitreous humor of the eye; reduce postoperative pressure; other ocular surgical procedures such as glaucoma, vitreous and retina surgery and in corneal transplantation); in hypodermoclysis (i.e., infusion of fluids and electrolytes into the hypodermis of the skin); cosmetic applications (e.g., in the treatment of cellulite, "pigskin" edema or "orange peel" edema); organ transplantation (e.g., associated with interstitial edemas in connection with grafting of an organ); pulmonary disease.

3. Other Uses

In further examples of its therapeutic use, modified PH20 polypeptides provided herein, can be used for such purposes as an antidote to local necrosis from paravenous injection of necrotic substances such as vinca alkaloids (Few et al. (1987) *Amer. J. Matern. Child Nurs.* 12, 23-26), treatment of ganglion cysts (Paul et al. (1997) *J Hand Surg.* 22 (2): 219-21) and treatment of tissue necrosis due to venous insufficiency (Elder et al. (1980) *Lancet* 648-649). Modified PH20 polypeptides also can be used to treat ganglion cysts (also known as a wrist cyst, Bible cyst, or dorsal tendon cyst), which are the most common soft tissue mass of the hand and are fluid filled sacs that can be felt below the skin.

Modified PH20 polypeptides can be used in the treatment of spinal cord injury by degrading chondroitin sulfate proteoglycans (CSPGs). Following spinal cord injury, glial scars containing CSPGs are produced by astrocytes. CSPGs play a crucial role in the inhibition of axon growth. In addition, the expression of CSPG has been shown to increase following injury of the central nervous system (CNS). Soluble PH20 also can be utilized for the treatment of herniated disks in a process known as chemonucleolysis. Chondroitinase ABC, an enzyme cleaving similar substrates as hyaluronidase, can induce the reduction of intradiscal pressure in the lumbar spine. There are three types of disk injuries. A protruded disk is one that is intact but bulging. In an extruded disk, the fibrous wrapper has torn and the NP has oozed out, but is still connected to the disk. In a sequestered disk, a fragment of the NP has broken loose from the disk and is free in the spinal canal. Chemonucleolysis is typically effective on protruded and extruded disks, but not on sequestered disk injuries.

4. Contraception

Modified PH20 polypeptides provided herein can be used as vaccines in contraceptive applications. PH20 is present in the male reproductive tract, and is expressed in both the testis and epididymis and is present in sperm. PH20 plays a role in fertilization by facilitating entry of the sperm through the cumulus layer surrounding the unfertilized egg. PH20 also is able to bind to hyaluronic acid (HA) on the zona pellucida during early phases of fertilization. This binding also initiates intracellular signaling that aids in the acrosome reaction. Immunization with PH20 has been show to be an effective contraceptive in male guinea pigs (Primakoff et al. (1988) *Nature* 335:543-546, Tung et al. (1997) *Biol. Reprod.* 56:1133-1141). It also has been shown to be an effective contraceptive in female guinea pigs due to the generation of anti-PH20 antibodies that prevent sperm and egg binding. In examples herein, the modified PH20 polypeptides can be inactive enzymes, such as any described in Sections C.2. The polypeptides can be administered directly or can be administered as a recombinant virus to deliver the antigen.

I. Examples

The following examples are included for illustrative purposes only and are not intended to limit the scope of the invention.

Example 1

Generation of Recombinant Human PH20 Hyaluronidase (rHuPH20)

A. Generation of a Soluble rHuPH20-Expressing Cell Line

A recombinant human PH20 hyaluronidase designated rHuPH20 was generated as described in published U.S. Publication No. US20110053247. Briefly, the pCI-PH20-IRES-DHFR-SV40pa (HZ24) plasmid (set forth in SEQ ID NO:5) was used to transfect Chinese Hamster Ovary (CHO) cells) (see e.g., U.S. Pat. Nos. 7,767,429 and 7,781,607 and U.S. Publication No. 2006-0104968). The HZ24 plasmid vector for expression of soluble rHuPH20 contains a pCI vector backbone (Promega), DNA encoding amino acids 1-482 of human PH20 hyaluronidase (SEQ ID NO:2), an internal ribosomal entry site (IRES) from the ECMV virus (Clontech), and the mouse dihydrofolate reductase (DHFR) gene. The pCI vector backbone also includes DNA encoding the Beta-Iactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:2, followed by a BamHI restriction site.

Non-transfected DG44 CHO cells growing in GIBCO Modified CD-CHO media for DHFR(−) cells, supplemented with 4 mM Glutamine and 18 mL/L Plurionic F68/L (Gibco), were seeded at $0.5 \times 10^6$ cells/mL in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 µg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 µF or at 350 V and 960 µF.

The cells were removed from the cuvettes after electroporation and transferred into 5 mL of Modified CD-CHO media for DHFR(−) cells, supplemented with 4 mM Glutamine and 18 mL/L Plurionic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity, using the microturbidity assay described in Example 8. The results are set forth in Table 6.

TABLE 6

Initial Hyaluronidase Activity of HZ24 Transfected DG44 CHO cells at 40 hours post-transfection

|  | Dilution | Activity (Units/mL) |
| --- | --- | --- |
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL). Ten clones were identified from the 5 plates grown without methotrexate (Table 7).

TABLE 7

Hyaluronidase activity of identified clones

| Plate/Well ID | Relative Hyaluronidase |
| --- | --- |
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate giving rise to clones producing hyaluronidase activity in excess of 1,000 Units/mL in shaker flasks (clone 3D35M; or Gen1 3D35M). A master cell bank (MCB) of the 3D35M cells was then prepared.

B. Production Gen2 Cells Containing Soluble human PH20 (rHuPH20)

The Gen1 3D35M cell line described in Example 1.A was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the $11^{th}$ passage, 2B2 cells were frozen in vials as a research cell bank (RCB).

The resultant 2B2 cells are dihydrofolate reductase deficient (dhfr−) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of 7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III.

C. Production of Gen2 Soluble rHuPH20 in 300 L Bioreactor Cell Culture

A vial of HZ24-2B2 was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, the vial of cells was thawed in a 37° C. water bath, medium was added and the cells were centrifuged. The cells were re-suspended in a 125 mL shake flask with 20 mL of fresh medium and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media were added. Before use, the reactor was checked for contamination. Approximately 30 L cells were transferred from the 36 L spinner flasks to the 400 L bioreactor (Braun) at an inoculation density of $4.0 \times 10^5$ viable cells per mL and a total volume of 260 L. Parameters were: temperature setpoint, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per mL with a maximal cell density of 12 million cells/mL. At harvest, the culture was sampled for mycoplasma, bioburden, endotoxin and virus in vitro and in vivo, by Transmission Electron Microscopy (TEM) and enzyme activity.

The culture was pumped by a peristaltic pump through four Millistak filtration system modules (Millipore) in parallel, each containing a layer of diatomaceous earth graded to 4-8 µm and a layer of diatomaceous earth graded to 1.4-1.1 µm, followed by a cellulose membrane, then through a second single Millistak filtration system (Millipore) containing a layer of diatomaceous earth graded to 0.4-0.11 µm and a layer of diatomaceous earth graded to <0.1 µm, followed by a cellulose membrane, and then through a 0.22 µm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorious), followed by a 10× buffer exchange with 10 mM Tris, 20 mM $Na_2SO_4$, pH 7.5 into a 0.22 µm final filter into a 50 L sterile storage bag.

The concentrated, diafiltered harvest was inactivated for virus. Prior to viral inactivation, a solution of 10% Triton® X-100, 3% tri (n-butyl) phosphate (TNBP) was prepared. The concentrated, diafiltered harvest was exposed to 1%

Triton® X-100, 0.3% TNBP for 1 hour in a 36 L glass reaction vessel immediately prior to purification on the Q column.

D. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL assay). The column was equilibrated with 5 column volumes of 10 mM Tris, 20 mM $Na_2SO_4$, pH 7.5. Following viral inactivation, the concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM Hepes, 50 mM NaCl, pH7.0. The protein was eluted with 10 mM Hepes, 400 mM NaCl, pH 7.0 into a 0.22 µm final filter into sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 µm final filter into a sterile bag. The flow through was sampled for bioburden, protein concentration and enzyme activity.

An aminophenyl boronate column (Prometics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 µm sterile filter into a sterile bag. The eluted sample was tested for bioburden, protein concentration and enzyme activity.

The HAP purified protein was then passed through a virus removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM virus removal filter. The filtered protein in 70 mM potassium phosphate, pH 7.0 was passed through a 0.22 µm final filter into a sterile bag. The filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kDa molecular weight cut off (MWCO) Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed though a 0.22 µm filter into a 20 L sterile storage bag. The protein was sampled and tested for protein concentration, enzyme activity, free sulfydryl groups, oligosaccharide profiling and osmolality. Lot number WRS2 was used as a standard in the assays described below, the results showed that the test description for appearance was clear and colorless; the pH was 7.4; the endotoxin level was <0.01 EU/mL; the osmolality was 308 mOsm/Kg; the density was 1.005 g/mL; the rHuPH20 content was 1.3 ppm; and the hyaluronidase activity was 145 USP U/mL.

The sterile filtered bulk protein was then aseptically dispensed at 20 mL into 30 mL sterile Teflon vials (Nalgene). The vials were then flash frozen and stored at −20±5° C.

Example 2

Generation of PH20 Mutant Library

A. Cloning and Mutagenesis

In this example, a human hyaluronidase PH20 library was created by cloning DNA encoding human PH20 into a plasmid followed by transfection and protein expression.

The library was created by mutagenesis of a PH20 template that is a codon optimized version of PH20 with an Ig Kappa leader sequence. Specifically, for generating the library of variants, the HZ24-PH20(OHO)-IRES-SEAP expression vector (set forth in SEQ ID NO:4) was used as a template, which contains the sequence of nucleotides encoding PH20 set forth in SEQ ID NO:1, which encodes a precursor PH20 set forth in SEQ ID NO:2 or a mature PH20 set forth in SEQ ID NO:3 lacking residues 1-22 corresponding to the IgK signal sequence. The backbone of the vector was derived from the original HZ24 vector containing the DHFR selection marker (see Example 1 and SEQ ID NO:5) with the addition of an IgK leader sequence and codon optimization. The expression vector also was modified to contain the gene for secreted alkaline phosphatase (SEAP). Hence, in addition to sequence encoding PH20, the HZ24-PH20(OHO)-IRES-SEAP expression vector also contains an internal ribosome entry site (EMCV IRES) that is linked to the coding sequence for the gene for secreted alkaline phosphatase (SEAP), and a single CMV promoter that drives expression of PH20 and SEAP in the construct. It also contains a gene for ampilcillin resistance. With reference to the sequence of nucleotides set forth in SEQ ID NO:4, the sequence of nucleotides encoding PH20 corresponds to nucleotides 1058-2464 (including the IgK leader sequence), the sequence of nucleotides encoding SEAP corresponds to nucleotides 2970-4529, and the ampicillin resistance gene corresponds to nucleotides 5778-6635.

The first library was made to generate encoded variant proteins wherein each of residues 23-469 of SEQ ID NO:2 (corresponding to residues 1-447 of SEQ ID NO:3 or residues 36-482 of SEQ ID NO:6) was changed to one of about 15 amino acid residues, such that each member contained a single amino change. The resulting library contained 6753 variant members, each containing a single amino acid mutation compared to residues 23-469 of SEQ ID NO:2 (corresponding to residues 1-447 of SEQ ID NO:3 or residues 36-482 of SEQ ID NO:6). Glycerol stocks of the resulting library were prepared and stored at −80° C. The amino acid replacements (mut) in each member are listed in Table 8 below, and correspond to amino acid replacements with reference to the sequence of amino acids of PH20 set forth in SEQ ID NO:3 (and SEQ ID NOS: 7 or 32-66, which are the mature sequence of PH20 or other C-terminally truncated fragments thereof). The corresponding mutated codons (cod) of each PH20 variant in the library are also listed in Table 8, and correspond to nucleotide residue changes in the corresponding encoding nucleotide for PH20 set forth as 1058-2464 of SEQ ID NO:4. Each member was expressed and screened for hyaluoridase activity as described below.

TABLE 8

PH20 Variants

| mut | cod | mut | cod | mut | cod | mut | cod | mut | cod | mut | cod |
|---|---|---|---|---|---|---|---|---|---|---|---|
| L001A | GCG | Y066S | AGT | R132N | AAT | G198T | ACT | V265G | GGT | I331K | AAG |
| L001C | TGT | Y066T | ACG | R132P | CCT | G198V | GTT | V265H | CAT | I331L | CTG |
| L001D | GAT | Y066V | GTG | R132Q | CAG | G198W | TGG | V265I | ATT | I331Q | CAG |
| L001E | GAG | I067C | TGT | R132S | AGT | G198Y | TAT | V265K | AAG | I331R | CGT |
| L001F | TTT | I067D | GAT | R132T | ACT | Y199A | GCG | V265L | CTG | I331S | AGT |
| L001G | GGT | I067E | GAG | R132V | GTG | Y199C | TGT | V265M | ATG | I331T | ACT |
| L001H | CAT | I067F | TTT | R132Y | TAT | Y199E | GAG | V265N | AAT | I331W | TGG |
| L001K | AAG | I067G | GGG | S133A | GCT | Y199G | GGG | V265P | CCT | I331Y | TAT |
| L001N | AAT | I067H | CAT | S133D | GAT | Y199H | CAT | V265Q | CAG | I332A | GCT |
| L001P | CCG | I067L | TTG | S133E | GAG | Y199I | ATT | V265R | AGG | I332C | TGT |
| L001Q | CAG | I067N | AAT | S133F | TTT | Y199K | AAG | V265S | TCT | I332D | GAT |
| L001R | CGG | I067P | CCG | S133G | GGG | Y199L | CTT | V265W | TGG | I332E | GAG |
| L001S | TCT | I067Q | CAG | S133H | CAT | Y199N | AAT | V265Y | TAT | I332F | TTT |
| L001T | ACG | I067R | CGG | S133I | ATT | Y199P | CCT | F266A | GCG | I332G | GGT |
| L001V | GTG | I067T | ACG | S133L | CTG | Y199Q | CAG | F266C | TGT | I332H | CAT |
| L001W | TGG | I067V | GTT | S133M | ATG | Y199R | AGG | F266D | GAT | I332K | AAG |
| N002A | GCT | I067W | TGG | S133N | AAT | Y199S | TCG | F266G | GGG | I332L | CTG |
| N002C | TGT | I067Y | TAT | S133P | CCT | Y199T | ACG | F266H | CAT | I332N | AAT |
| N002F | TTT | D068A | GCT | S133R | CGG | Y199W | TGG | F266L | CTT | I332P | CCT |
| N002G | GGG | D068C | TGT | S133T | ACT | N200A | GCT | F266M | CCG | I332R | AGG |
| N002H | CAT | D068E | GAG | S133V | GTT | N200D | GAT | F266P | ATG | I332S | AGT |
| N002I | ATT | D068G | GGG | S133W | TGG | N200F | CAG | F266Q | CAG | I332T | ACT |
| N002K | AAG | D068H | CAC | I134A | GCT | N200G | GGT | F266R | CGG | I332Y | TAT |
| N002L | TTG | D068I | ATT | I134C | TGT | N200H | CAT | F266S | TCG | N333A | GCT |
| N002P | CCG | D068K | AAG | I134D | GAT | N200K | AAG | F266T | ACG | N333E | GAG |
| N002Q | CAG | D068L | TTG | I134F | TTT | N200L | CTG | F266V | GTG | N333G | GGT |
| N002S | AGT | D068P | CCT | I134G | GGG | N200M | ATG | F266W | TGG | N333H | CAT |
| N002T | ACG | D068Q | CAG | I134H | CAT | N200P | CCT | F266Y | TAT | N333I | ATT |
| N002V | GTT | D068R | CGG | I134K | AAG | N200Q | CAG | A267D | GAT | N333K | AAG |
| N002W | TGG | D068S | TCG | I134L | TTG | N200R | AGG | A267E | GAG | N333L | CTG |
| N002Y | TAT | D068T | ACT | I134P | CCT | N200S | TCT | A267G | GGT | N333M | ATG |
| F003A | GCT | D068V | GTG | I134Q | CAG | N200T | ACT | A267H | CAT | N333P | CCT |
| F003E | GAG | D068Y | TAT | I134R | CGT | N200V | GTG | A267I | ATT | N333R | CGG |
| F003G | GGG | S069A | GCT | I134S | TCG | N200W | TGG | A267K | AAG | N333S | AGT |
| F003H | CAT | S069C | TGT | I134T | ACT | N200Y | TAT | A267L | CTT | N333T | ACT |
| F003I | ATT | S069E | GAG | I134V | GTG | G201A | GCG | A267M | ATG | N333V | GTT |
| F003K | AAG | S069F | TTT | I134W | TGG | G201E | GAG | A267N | AAT | N333W | TGG |
| F003L | TTG | S069G | GGG | E135A | GCT | G201F | TTT | A267P | CCG | N333Y | TAT |
| F003M | ATG | S069I | ATT | E135C | TGT | G201H | CAT | A267R | AGG | V334A | GCT |
| F003N | AAT | S069L | CTT | E135D | GAT | G201K | AAG | A267S | TCT | V334C | TGT |
| F003P | CCT | S069M | ATG | E135F | TTT | G201L | CTT | A267T | GTG | V334D | GAT |
| F003R | CGT | S069N | AAT | E135G | GGG | G201M | ATG | A267V | ACT | V334E | GAG |
| F003S | TCG | S069P | CCT | E135H | CAT | G201N | AAT | A267W | TGG | V334G | GGG |
| F003T | ACT | S069R | CGT | E135K | AAG | G201P | CCT | Y268A | GCT | V334H | CAT |
| F003V | GTG | S069T | ACG | E135L | TTG | G201Q | CAG | Y268C | TGT | V334L | TTG |
| F003Y | TAT | S069V | GTT | E135N | AAT | G201R | CGT | Y268F | TTT | V334M | ATG |
| R004A | GCG | S069W | TGG | E135P | CCT | G201S | TCG | Y268G | GGG | V334N | AAT |
| R004D | GAT | S069Y | TAT | E135Q | CAG | G201T | ACG | Y268H | CAT | V334P | CCT |
| R004E | GAG | I070A | GCT | E135R | CGG | G201V | GTG | Y268K | AAG | V334Q | CAG |
| R004F | TTT | I070C | TGT | E135S | TCT | G201W | TGG | Y268L | CTT | V334R | AGG |
| R004G | GGG | I070F | TTT | E135W | TGG | S202A | GCG | Y268N | AAT | V334S | TCT |
| R004I | ATT | I070G | GGG | E135Y | TAT | S202E | GAG | Y268P | CCT | V334T | ACT |
| R004L | TTG | I070H | CAT | L136A | GCT | S202F | TTT | Y268Q | CAG | V334Y | TAT |
| R004M | ATG | I070K | AAG | L136C | TGT | S202G | GGT | Y268R | CGT | T335A | GCT |
| R004N | AAT | I070L | TTG | L136D | GAT | S202H | CAT | Y268S | TCG | T335C | TGT |

TABLE 8-continued

PH20 Variants

| mut | cod | mut | cod | mut | cod | mut | cod | mut | cod | mut | cod |
|---|---|---|---|---|---|---|---|---|---|---|---|
| R004P | CCT | I070N | AAT | L136F | TTT | S202K | AAG | Y268T | ACT | T335F | TTT |
| R004S | TCT | I070P | CCG | L136G | GGT | S202M | ATG | Y268V | GTG | T335G | GGT |
| R004T | ACG | I070Q | CAG | L136H | CAT | S202N | AAT | Y268W | TGG | T335H | CAT |
| R004V | GTG | I070R | CGT | L136I | ATT | S202P | CCT | T269A | GCT | T335I | ATT |
| R004W | TGG | I070S | TCT | L136M | ATG | S202Q | CAG | T269C | TGT | T335K | AAG |
| R004Y | TAT | I070T | ACT | L136N | AAT | S202R | CGT | T269D | GAT | T335L | TTG |
| A005D | GAT | I070V | GTT | L136P | CCT | S202T | ACG | T269E | GAG | T335N | AAT |
| A005G | GGG | I070Y | TAT | L136Q | CAG | S202V | GTT | T269G | GGT | T335P | CCT |
| A005H | CAT | T071A | GCT | L136R | CGT | S202W | TGG | T269K | AAG | T335Q | CAG |
| A005I | ATT | T071C | TGT | L136S | TCG | S202Y | TAT | T269L | CTG | T335S | TCT |
| A005L | CTT | T071D | GAT | L136T | ACT | C203A | GCG | T269M | ATG | T335V | GTG |
| A005M | ATG | T071E | GAG | L136W | TGG | C203D | GAT | T269N | AAT | T335W | TGG |
| A005N | AAT | T071G | GGG | V137A | GCT | C203E | GAG | T269P | CCG | T335Y | TAT |
| A005P | CCG | T071H | CAT | V137C | TGT | C203G | GGG | T269Q | CAG | L336A | GCT |
| A005Q | CAG | T071L | TTG | V137E | GAG | C203H | CAT | T269R | AGG | L336E | GAG |
| A005R | AGG | T071M | ATG | V137F | TTT | C203L | CTT | T269S | TCG | L336F | TTT |
| A005S | TCG | T071N | AAT | V137G | GGG | C203M | ATG | T269V | GTG | L336G | GGG |
| A005T | ACG | T071P | CCT | V137H | CAT | C203N | AAT | T269Y | TAT | L336H | CAT |
| A005V | GTG | T071Q | CAG | V137I | ATT | C203P | CCG | R270A | GCT | L336K | AAG |
| A005W | TGG | T071R | CGG | V137L | TTG | C203Q | CAG | R270C | TGT | L336M | ATG |
| A005Y | TAT | T071S | TCG | V137N | AAT | C203R | AGG | R270D | GAT | L336N | AAT |
| P006A | GCG | T071V | GTG | V137P | CCT | C203S | AGT | R270E | GAG | L336P | CCT |
| P006D | GAT | T071Y | TAT | V137Q | CAG | C203T | ACT | R270F | TTT | L336R | AGG |
| P006E | GAG | G072A | GCT | V137R | CGT | C203V | GTG | R270G | GGG | L336S | TCT |
| P006F | TTT | G072C | TGT | V137S | TCT | C203W | TGG | R270H | CAT | L336T | ACT |
| P006G | GGG | G072D | GAT | V137T | ACT | F204A | GCG | R270I | ATT | L336V | GTG |
| P006H | CAT | G072E | GAG | V137W | TGG | F204C | TGT | R270M | ATG | L336W | TGG |
| P006K | AAG | G072F | TTT | V137Y | TAT | F204E | GAG | R270N | AAT | L336Y | TAT |
| P006L | CTT | G072H | CAT | Q138A | GCT | F204G | GGG | R270P | CCT | A337C | TGT |
| P006N | AAT | G072I | ATT | Q138C | TGT | F204H | CAT | R270Q | CAG | A337F | TTT |
| P006Q | CAG | G072K | AAG | Q138E | GAG | F204I | ATT | R270S | TCG | A337G | GGG |
| P006R | AGG | G072L | TTG | Q138F | TTT | F204K | AAG | R270T | ACT | A337H | CAT |
| P006S | AGT | G072M | ATG | Q138G | GGG | F204L | CTT | R270V | GTG | A337I | ATT |
| P006T | ACG | G072P | CCT | Q138H | CAT | F204M | ATG | R270Y | TAT | A337K | AAG |
| P006V | GTG | G072Q | CAG | Q138I | ATT | F204P | CCT | I271A | GCT | A337L | TTG |
| P006W | TGG | G072R | CGG | Q138L | TTG | F204Q | CAG | I271D | GAT | A337M | ATG |
| P006Y | TAT | G072S | TCT | Q138M | ATG | F204R | AGG | I271E | GAG | A337N | AAT |
| P007A | GCT | G072T | ACT | Q138N | AAT | F204S | AGT | I271F | TTT | A337P | CCT |
| P007C | TGT | G072V | GTG | Q138R | CGT | F204T | ACT | I271G | GGG | A337R | CGG |
| P007D | GAT | G072W | TGG | Q138S | AGT | F204V | GTG | I271H | CAT | A337S | TCT |
| P007F | TTT | G072Y | TAT | Q138V | GTT | F204W | TGG | I271K | AAG | A337T | ACT |
| P007G | GGT | V073A | GCG | Q138W | TGG | N205A | GCT | I271L | CTT | A337V | GTT |
| P007H | CAT | V073C | TGT | Q138Y | TAT | N205D | GAT | I271M | ATG | A337W | TGG |
| P007I | ATT | V073D | GAT | Q139A | GCT | N205E | GAG | I271P | CCT | A338C | TGT |
| P007K | AAG | V073F | TTT | Q139C | TGT | N205F | TTT | I271R | AGG | A338D | GAT |
| P007L | TTG | V073G | GGG | Q139D | GAT | N205G | GAT | I271S | AGT | A338E | GAG |
| P007M | ATG | V073H | CAT | Q139E | GAG | N205K | AAG | I271T | ACT | A338F | TTT |
| P007Q | CAG | V073K | AAG | Q139F | TTT | N205L | CTG | I271V | GTT | A338G | GGG |
| P007R | CGG | V073L | CTT | Q139G | GGG | N205M | ATG | I271W | TGG | A338H | CAT |
| P007S | AGT | V073M | ATG | Q139H | CAT | N205P | CCT | V272A | GCT | A338I | ATT |
| P007T | ACT | V073P | CCG | Q139K | AAG | N205R | AGG | V272C | TGT | A338K | AAG |
| P007V | GTG | V073Q | CAG | Q139L | CTG | N205S | TCG | V272D | GAT | A338L | CTT |
| P007W | TGG | V073R | TGG | Q139M | ATG | N205T | ACG | V272E | GAG | A338P | CCT |
| P007Y | TAT | V073S | TCG | Q139P | CCT | N205V | GTG | V272G | GGG | A338Q | CAG |
| V008A | GCT | V073T | ACG | Q139R | CGT | N205W | TGG | V272H | CAT | A338R | CGT |
| V008D | GAT | V073W | CGG | Q139S | TCT | N205Y | TAT | V272K | AAG | A338S | TCG |
| V008E | GAG | T074A | GCT | Q139T | ACT | V206C | TGT | V272L | TTG | A338T | ACT |
| V008G | GGT | T074C | TGT | Q139V | GTG | V206D | GAT | V272M | ATG | A338V | GTG |
| V008H | CAT | T074E | GAG | Q140A | GCT | V206F | TTT | V272N | AAT | K339D | GAT |
| V008I | ATT | T074F | TTT | Q140C | TGT | V206G | GGG | V272P | CCT | K339E | GAG |
| V008L | TTG | T074G | GGT | Q140D | GAT | V206H | CAT | V272R | AGG | K339F | TTT |
| V008M | ATG | T074H | CAT | Q140F | TTT | V206I | ATT | V272S | TCG | K339G | GGG |
| V008N | AAT | T074K | AAG | Q140G | GGG | V206K | AAG | V272T | ACT | K339H | CAT |
| V008P | CCT | T074L | TTG | Q140H | CAT | V206L | CTT | V272W | TGG | K339L | CTG |
| V008Q | CAG | T074M | ATG | Q140I | ATT | V206M | ATG | F273A | GCT | K339M | ATG |
| V008R | CGG | T074N | AAT | Q140K | AAG | V206P | CCG | F273C | TGT | K339N | AAT |
| V008S | TCT | T074P | CCG | Q140L | TTG | V206Q | CAG | F273D | GAT | K339P | CCT |
| V008T | ACT | T074R | CGG | Q140M | ATG | V206R | CGG | F273G | GGG | K339R | CGG |
| V008W | TGG | T074S | TCG | Q140R | CGG | V206S | TCT | F273H | CAT | K339S | AGT |
| I009A | GCT | T074V | GTG | Q140S | AGT | V206T | ACG | F273I | ATT | K339T | ACT |
| I009C | TGT | T074W | TGG | Q140V | GTG | V206Y | TAT | F273L | CTG | K339V | GTT |
| I009D | GAT | V075A | GCG | Q140W | TGG | E207A | GCT | F273P | CCT | K339W | TGG |
| I009E | GAG | V075C | TGT | Q140Y | TAT | E207F | TTT | F273Q | CAG | K339Y | TAT |
| I009G | GGG | V075D | GAT | N141A | GCT | E207G | GGG | F273R | CGG | M340A | GCT |
| I009H | CAT | V075F | TTT | N141D | GAT | E207H | CAT | F273S | TCG | M340C | TGT |
| I009K | AAG | V075G | GGG | N141E | GAG | E207I | ATT | F273T | ACG | M340D | GAT |

TABLE 8-continued

PH20 Variants

| mut | cod | mut | cod | mut | cod | mut | cod | mut | cod | mut | cod |
|---|---|---|---|---|---|---|---|---|---|---|---|
| I009L | CTT | V075H | CAT | N141F | TTT | E207K | AAG | F273V | GTT | M340E | GAG |
| I009N | AAT | V075L | CTT | N141G | GGT | E207L | TTG | F273W | TGG | M340F | TTT |
| I009P | CCT | V075M | ATG | N141H | CAT | E207M | ATG | F273Y | TAT | M340G | GGG |
| I009Q | CAG | V075N | AAT | N141L | TTG | E207P | CCG | T274A | GCG | M340H | CAT |
| I009R | CGG | V075P | CCG | N141M | ATG | E207Q | CAG | T274C | TGT | M340K | AAG |
| I009S | AGT | V075Q | CAG | N141P | CCT | E207R | AGG | T274E | GAG | M340L | CTG |
| I009T | ACG | V075R | CGT | N141Q | CAG | E207S | TCT | T274F | TTT | M340P | CCT |
| I009V | GTT | V075S | TCT | N141R | CGT | E207T | ACG | T274G | GGG | M340R | CGG |
| P010D | GAT | V075T | ACT | N141S | TCT | E207V | GTT | T274H | CAT | M340S | TCG |
| P010E | GAG | V075W | TGG | N141T | ACT | E207W | TGG | T274L | CTG | M340T | ACT |
| P010F | TTT | V075Y | TAT | N141V | GTT | I208A | GCT | T274N | AAT | M340V | GTG |
| P010G | GGT | N076A | GCT | N141W | TGG | I208C | TGT | T274P | CCT | M340W | TGG |
| P010H | CAT | N076C | TGT | N141Y | TAT | I208D | GAT | T274Q | CAG | C341A | GCT |
| P010I | ATT | N076D | GAT | V142C | TGT | I208E | GAG | T274R | CGT | C341E | GAG |
| P010L | CTT | N076F | TTT | V142D | GAT | I208G | GGG | T274S | AGT | C341G | GGG |
| P010M | ATG | N076G | GGG | V142E | GAG | I208K | AAG | T274V | GTT | C341H | CAT |
| P010N | AAT | N076I | ATT | V142G | GGG | I208L | TTG | T274W | TGG | C341K | AAG |
| P010Q | CAG | N076K | AAG | V142H | CAT | I208M | ATG | T274Y | TAT | C341L | TTG |
| P010R | CGG | N076L | CTG | V142I | ATT | I208P | CCG | D275A | GCT | C341M | ATG |
| P010S | TCG | N076P | CCT | V142K | AAG | I208Q | CAG | D275C | TGT | C341N | AAT |
| P010T | ACT | N076Q | CAG | V142L | TTG | I208R | CGT | D275E | GAG | C341Q | CAG |
| P010W | TGG | N076R | CGT | V142M | ATG | I208S | AGT | D275F | TTT | C341R | AGG |
| P010Y | TAT | N076S | AGT | V142N | AAT | I208T | ACG | D275G | GGG | C341S | TCT |
| N011A | GCG | N076T | ACT | V142P | CCT | I208V | GTG | D275I | ATT | C341T | ACT |
| N011C | TGT | N076V | GTT | V142Q | CAG | I208W | TGG | D275K | AAG | C341V | GTT |
| N011D | GAT | N076W | TGG | V142R | CGG | K209A | GCG | D275L | CTT | C341W | TGG |
| N011E | GAG | G077D | GAT | V142S | AGT | K209C | TGT | D275M | ATG | C341Y | TAT |
| N011F | TTT | G077E | GAG | V142T | ACT | K209D | GAT | D275Q | CAG | S342A | GCT |
| N011G | GGG | G077F | TTT | Q143C | TGT | K209E | GAG | D275R | CGT | S342D | GAT |
| N011H | CAT | G077H | CAT | Q143E | GAG | K209F | TTT | D275S | TCG | S342E | GAG |
| N011I | ATT | G077K | AAG | Q143F | TTT | K209G | GGT | D275T | ACT | S342F | TTT |
| N011K | AAG | G077L | TTG | Q143G | GGG | K209L | CTG | D275V | GTG | S342G | GGG |
| N011L | CTG | G077M | ATG | Q143H | CAT | K209N | AAT | D275W | TGG | S342H | CAT |
| N011P | CCG | G077N | AAT | Q143I | ATT | K209P | CCG | Q276C | TGT | S342I | ATT |
| N011S | TCG | G077P | CCG | Q143K | AAG | K209R | CGG | Q276D | GAT | S342K | AAG |
| N011T | ACG | G077Q | CAG | Q143L | TTG | K209S | AGT | Q276E | GAG | S342L | TTG |
| N011W | TGG | G077R | CGT | Q143M | ATG | K209T | ACT | Q276F | TTT | S342M | ATG |
| N011Y | TAT | G077S | TCG | Q143N | AAT | K209V | GTT | Q276G | GGG | S342P | CCT |
| V012A | GCT | G077T | ACG | Q143P | CCT | K209W | TGG | Q276H | CAT | S342Q | CAG |
| V012D | GAT | G077V | GTG | Q143R | CGG | K209Y | TAT | Q276I | ATT | S342R | CGG |
| V012E | GAG | G077Y | TAT | Q143S | TCG | R210A | GCG | Q276L | CTT | S342T | ACT |
| V012G | GGG | G078A | GCG | Q143T | ACT | R210C | TGT | Q276M | ATG | S342Y | TAT |
| V012H | CAT | G078C | TGT | Q143V | GTG | R210D | GAT | Q276P | CCT | Q343C | TGT |
| V012I | ATT | G078D | GAT | Q143Y | TAT | R210E | GAG | Q276R | CGT | Q343D | GAT |
| V012K | AAG | G078H | CAT | L144A | GCT | R210G | GGT | Q276S | AGT | Q343E | GAG |
| V012L | CTT | G078I | ATT | L144E | GAG | R210K | AAG | Q276V | GTT | Q343F | TTT |
| V012M | ATG | G078K | AAG | L144F | TTT | R210L | CTG | Q276W | TGG | Q343G | GGG |
| V012N | AAT | G078L | TTG | L144G | GGG | R210M | ATG | Q276Y | TAT | Q343I | ATT |
| V012P | CCG | G078M | ATG | L144I | ATT | R210N | AAT | V277A | GCT | Q343L | CTT |
| V012R | AGG | G078P | CCG | L144K | AAG | R210P | CCT | V277C | TGT | Q343M | ATG |
| V012S | TCG | G078Q | CAG | L144N | AAT | R210S | TCG | V277D | GAT | Q343P | CCT |
| V012T | ACT | G078R | AGG | L144P | CCT | R210T | ACT | V277E | GAG | Q343R | AGG |
| V012W | TGG | G078S | TCG | L144Q | CAG | R210V | GTG | V277G | GGG | Q343S | AGT |
| P013A | GCT | G078T | ACT | L144R | CGT | R210W | TGG | V277H | CAT | Q343T | ACT |
| P013E | GAG | G078V | GTG | L144S | TCT | R210Y | TAT | V277K | AAG | Q343V | GTG |
| P013F | TTT | G078Y | TAT | L144T | ACT | N211A | GCG | V277L | TTG | Q343W | TGG |
| P013G | GGG | I079A | GCT | L144V | GTT | V277M | ATG | V277M | ATG | Q343Y | TAT |
| P013H | CAT | I079D | GAT | L144W | TGG | N211F | TTT | V277N | AAT | V344E | GAG |
| P013I | ATT | I079F | TTT | L144Y | TAT | N211G | GGG | V277Q | CAG | V344F | TTT |
| P013L | CTT | I079G | GGG | S145A | GCT | N211H | CAT | V277R | AGG | V344G | GGG |
| P013M | ATG | I079H | CAT | S145C | TGT | N211I | ATT | V277S | TCT | V344H | CAT |
| P013Q | CAG | I079K | AAG | S145D | GAT | N211K | AAG | V277T | ACT | V344I | ATT |
| P013R | CGT | I079L | TTG | S145E | GAG | N211L | CTG | V277Y | TAT | V344L | CTG |
| P013S | TCG | I079N | AAT | S145F | TTT | N211M | ATG | L278A | GCT | V344M | ATG |
| P013T | ACT | I079P | CCG | S145G | GGG | N211P | CCT | L278E | GAG | V344N | AAT |
| P013V | GTG | I079R | CGT | S145H | CAT | N211R | CGG | L278F | TTT | V344P | CCT |
| P013W | TGG | I079S | AGT | S145L | TTG | N211S | AGT | L278G | GGG | V344Q | CAG |
| P013Y | TAT | I079T | ACT | S145M | ATG | N211T | ACT | L278H | CAT | V344R | CGT |
| F014A | GCG | I079V | GTT | S145N | AAT | N211V | GTT | L278I | ATT | V344S | TCG |
| F014D | GAT | I079W | TGG | S145P | CCT | N211W | TGG | L278K | AAG | V344T | ACT |
| F014E | GAG | I079Y | TAT | S145R | CGT | D212A | GCT | L278M | ATG | V344W | TGG |
| F014G | GGT | P080A | GCG | S145T | ACT | D212E | GAG | L278N | AAT | V344Y | TAT |
| F014H | CAT | P080D | GAT | S145V | GTT | D212G | GGG | L278P | CCG | L345A | GCT |
| F014I | ATT | P080E | GAG | S145W | TGG | D212H | CAT | L278R | CGT | L345C | TGT |
| F014K | AAG | P080F | TTT | L146A | GCT | D212I | ATT | L278S | TCT | L345D | GAT |
| F014M | ATG | P080G | GGG | L146C | TGT | D212K | AAG | L278T | ACT | L345E | GAG |

TABLE 8-continued

PH20 Variants

| mut | cod | mut | cod | mut | cod | mut | cod | mut | cod | mut | cod |
|---|---|---|---|---|---|---|---|---|---|---|---|
| F014N | AAT | P080I | ATT | L146E | GAG | D212L | CTG | L278V | GTT | L345G | GGG |
| F014P | CCT | P080K | AAG | L146G | GGG | D212M | ATG | L278Y | TAT | L345H | CAT |
| F014Q | CAG | P080L | CTT | L146H | CAT | D212N | AAT | K279A | GCG | L345K | AAG |
| F014R | CGG | P080M | ATG | L146I | ATT | D212P | CCT | K279C | TGT | L345N | AAT |
| F014T | ACT | P080N | AAT | L146K | AAG | D212Q | CAG | K279D | GAT | L345P | CCT |
| F014V | GTG | P080R | AGG | L146N | AAT | D212S | TCG | K279F | TTT | L345Q | CAG |
| F014W | TGG | P080S | TCT | L146P | CCT | D212T | ACT | K279G | GGG | L345R | CGT |
| L015A | GCG | P080T | ACG | L146Q | CAG | D212V | GTG | K279H | CAT | L345T | ACT |
| L015E | GAG | P080V | GTG | L146R | CGG | D212W | TGG | K279L | CTG | L345V | GTT |
| L015F | TTT | P080Y | TAT | L146S | TCG | D213A | GCT | K279P | CCT | L345W | TGG |
| L015G | GGG | Q081A | GCT | L146T | ACT | D213E | GAG | K279Q | CAG | L345Y | TAT |
| L015K | AAG | Q081C | TGT | L146V | GTT | D213G | GGG | K279R | AGG | C346A | GCT |
| L015M | ATG | Q081E | GAG | L146Y | TAT | D213H | CAT | K279S | TCT | C346D | GAT |
| L015N | AAT | Q081F | TTT | T147A | GCT | D213K | AAG | K279T | ACG | C346F | TTT |
| L015P | CCG | Q081G | GGG | T147C | TGT | D213L | CTG | K279V | GTG | C346G | GGG |
| L015Q | CAG | Q081H | CAT | T147D | GAT | D213M | ATG | K279W | TGG | C346I | ATT |
| L015R | CGG | Q081L | CTG | T147F | TTT | D213N | AAT | K279Y | TAT | C346K | AAG |
| L015S | TCG | Q081M | ATG | T147G | GGT | D213P | CCT | F280D | GAT | C346L | CTT |
| L015T | ACT | Q081N | AAT | T147I | ATT | D213Q | CAG | F280E | GAG | C346M | ATG |
| L015V | GTT | Q081P | CCG | T147L | CTT | D213R | CGT | F280G | GGG | C346P | CCT |
| L015W | TGG | Q081R | AGG | T147M | ATG | D213S | TCG | F280H | CAT | C346Q | CAG |
| L015Y | TAT | Q081S | TCT | T147P | CCT | D213V | GTG | F280I | ATT | C346R | CGG |
| W016A | GCG | Q081V | GTT | T147Q | CAG | D213W | TGG | F280L | TTG | C346S | TCT |
| W016C | TGT | Q081W | TGG | T147R | CGT | D213Y | TAT | F280M | ATG | C346T | ACT |
| W016D | GAT | Q081Y | TAT | T147S | AGT | L214A | GCG | F280N | AAT | C346V | GTG |
| W016E | GAG | K082A | GCT | T147V | GTT | L214C | TGT | F280P | CCT | C346W | TGG |
| W016F | TTT | K082E | GAG | T147W | TGG | L214D | GAT | F280Q | CAG | Q347A | GCT |
| W016G | GGT | K082G | GGT | T147Y | TAT | L214E | GAG | F280R | CGT | Q347C | TGT |
| W016H | CAT | K082H | CAT | E148C | TGT | L214G | GGG | F280S | TCG | Q347E | GAG |
| W016K | AAG | K082I | ATT | E148F | TTT | L214H | CAT | F280T | ACT | Q347F | TTT |
| W016L | CTT | K082L | CTT | E148G | GGG | L214K | AAG | F280V | GTG | Q347G | GGT |
| W016M | ATG | K082M | ATG | E148H | CAT | L214N | AAT | F280W | TGG | Q347I | ATT |
| W016P | CCT | K082N | AAT | E148I | ATT | L214P | CCG | L281A | GCG | Q347L | TTG |
| W016R | CGT | K082P | CCT | E148K | AAG | L214Q | CAG | L281D | GAT | Q347M | ATG |
| W016S | TCG | K082Q | CAG | E148L | CTG | L214R | CGG | L281F | TTT | Q347P | CCT |
| W016T | ACT | K082R | CGT | E148P | CCT | L214S | TCG | L281G | GGT | Q347R | AGG |
| W016Y | TAT | K082S | AGT | E148Q | CAG | L214T | ACG | L281H | CAT | Q347S | TCT |
| A017D | GAT | K082T | ACT | E148R | CGG | L214V | GTG | L281I | ATT | Q347T | ACT |
| A017E | GAG | K082V | GTG | E148S | TCT | L214Y | TAT | L281K | AAG | Q347V | GTG |
| A017G | GGG | K082W | TGG | E148T | ACT | S215A | GCT | L281N | AAT | Q347W | TGG |
| A017H | CAT | K082Y | TAT | E148V | GTG | S215C | TGT | L281P | CCG | Q347Y | TAT |
| A017I | ATT | I083E | GAG | E148W | TGG | S215D | GAT | L281Q | CAG | E348C | TGT |
| A017L | CTT | I083F | TTT | E148Y | TAT | S215E | GAG | L281R | CGG | E348D | GAT |
| A017N | AAT | I083G | GGT | A149C | TGT | S215G | GGG | L281S | AGT | E348G | GGT |
| A017P | CCG | I083H | CAT | A149E | GAG | S215H | CAT | L281V | GTT | E348H | CAT |
| A017Q | CAG | I083K | AAG | A149F | TTT | S215K | AAG | L281W | TGG | E348I | ATT |
| A017R | AGG | I083L | CTG | A149G | GGT | S215L | TTG | L281Y | TAT | E348L | TTG |
| A017S | TCG | I083N | AAT | A149K | AAG | S215M | ATG | S282A | GCG | E348M | ATG |
| A017T | ACG | I083P | CCT | A149L | TTG | S215P | CCG | S282C | TGT | E348P | CCT |
| A017V | GTG | I083Q | CAA | A149M | ATG | S215Q | CAG | S282D | GAT | E348Q | CAG |
| A017W | TGG | I083R | CGT | A149P | CCT | S215R | CGG | S282E | GAG | E348R | CGG |
| A017Y | TAT | I083S | TCG | A149Q | CAG | S215T | ACT | S282F | TTT | E348S | TCT |
| W018C | TGT | I083T | ACT | A149R | CGG | S215V | GTG | S282G | GGT | E348T | ACT |
| W018D | GAT | I083V | GTT | A149S | TCT | S215W | TGG | S282L | CTT | E348V | GTT |
| W018F | TTT | I083Y | TAT | A149T | ACT | W216D | GAT | S282M | ATG | E348W | TGG |
| W018G | GGG | S084D | GAT | A149V | GTT | W216E | GAG | S282P | CCT | E348Y | TAT |
| W018H | CAT | S084E | GAG | A149W | TGG | W216G | GGT | S282Q | CAG | Q349A | GCT |
| W018I | ATT | S084F | TTT | A149Y | TAT | W216H | CAT | S282R | CGT | Q349D | GAT |
| W018L | CTG | S084G | GGT | T150A | GCT | W216I | ATT | S282T | ACT | Q349E | GAG |
| W018M | ATG | S084H | CAT | T150C | TGT | W216K | AAG | S282V | GTT | Q349F | TTT |
| W018P | CCG | S084I | ATT | T150D | GAT | W216L | CTG | S282W | TGG | Q349G | GGT |
| W018Q | CAG | S084L | CTT | T150E | GAG | W216M | ATG | S282Y | TAT | Q349H | CAT |
| W018R | CGG | S084M | ATG | T150F | TTT | W216N | AAT | Q283A | GCG | Q349K | AAG |
| W018S | AGT | S084N | AAT | T150G | GGG | W216P | CCT | Q283C | TGT | Q349L | CTG |
| W018T | ACG | S084P | CCT | T150I | ATT | W216Q | CAG | Q283D | GAT | Q349M | ATG |
| W018V | GTG | S084Q | CAG | T150L | TTG | W216R | CGG | Q283E | GAG | Q349N | AAT |
| W018Y | TAT | S084R | CGG | T150N | AAT | W216T | ACG | Q283F | TTT | Q349P | CCT |
| N019A | GCG | S084T | ACT | T150P | CCT | W216V | GTG | Q283G | GGG | Q349R | CGT |
| N019C | TGT | S084W | TGG | T150R | AGG | W216Y | TAT | Q283H | CAT | Q349S | TCG |
| N019F | TTT | S084Y | TAT | T150S | TCT | L217A | GCG | Q283L | CTT | Q349T | ACT |
| N019G | GGG | L085A | GCT | T150V | GTG | L217C | TGT | Q283N | AAT | Q349V | GTG |
| N019H | CAT | L085C | TGT | T150W | TGG | L217E | GAG | Q283P | CCG | Q349W | TGG |
| N019I | ATT | L085D | GAT | T150Y | TAT | L217G | GGT | Q283R | CGT | Q349Y | TAT |
| N019L | CTG | L085E | GAG | E151A | GCT | L217H | CAT | Q283S | TCT | G350A | GCT |
| N019M | ATG | L085F | TTT | E151C | TGT | L217I | ATT | Q283T | ACT | G350D | GAT |
| N019P | CCG | L085G | GGG | E151G | GGT | L217M | ATG | Q283W | TGG | G350E | GAG |

TABLE 8-continued

PH20 Variants

| mut | cod | mut | cod | mut | cod | mut | cod | mut | cod | mut | cod |
|---|---|---|---|---|---|---|---|---|---|---|---|
| N019Q | CAG | L085H | CAT | E151H | CAT | L217P | CCG | Q283Y | TAT | G350F | TTT |
| N019R | CGT | L085K | AAG | E151K | AAG | L217Q | CAG | D284A | GCT | G350H | CAT |
| N019S | TCG | L085N | AAT | E151L | TTG | L217R | AGG | D284C | TGT | G350K | AAG |
| N019V | GTT | L085P | CCT | E151M | ATG | L217S | TCT | D284E | GAG | G350L | CTG |
| N019W | TGG | L085Q | CAG | E151N | AAT | L217T | ACG | D284G | GGT | G350M | ATG |
| N019Y | TAT | L085R | CGT | E151Q | CAG | L217V | GTG | D284H | CAT | G350N | AAT |
| A020D | GAT | L085S | TCG | E151R | AGG | L217W | TGG | D284I | ATT | G350P | CCT |
| A020E | GAG | L085T | ACT | E151S | TCG | L217Y | TAT | D284L | TTG | G350R | CGT |
| A020F | TTT | L085V | GTT | E151T | ACT | W218A | GCT | D284M | ATG | G350S | TCT |
| A020G | GGG | Q086A | GCT | E151V | GTT | W218D | GAT | D284N | AAT | G350T | ACT |
| A020H | CAT | Q086C | TGT | E151W | TGG | W218F | TTT | D284P | CCG | G350V | GTG |
| A020K | AAG | Q086D | GAT | E151Y | TAT | W218G | GGT | D284Q | CAG | G350Y | TAT |
| A020L | CTG | Q086E | GAG | K152A | GCT | W218H | CAT | D284S | TCT | V351A | GCT |
| A020N | AAT | Q086F | TTT | K152C | TGT | W218I | ATT | D284T | ACG | V351C | TGT |
| A020P | CCG | Q086G | GGT | K152F | TTT | W218K | AAG | D284V | GTT | V351D | GAT |
| A020Q | CAG | Q086H | CAT | K152G | GGT | W218L | CTT | D284Y | TAT | V351E | GAG |
| A020R | CGT | Q086I | ATT | K152I | ATT | W218M | ATG | E285A | GCG | V351F | TTT |
| A020S | TCT | Q086K | AAG | K152L | TTG | W218P | CCT | E285F | TTT | V351G | GGT |
| A020T | ACT | Q086L | CTG | K152M | ATG | W218Q | CAG | E285G | GGG | V351H | CAT |
| A020V | GTT | Q086M | ATG | K152N | AAT | W218R | CGG | E285H | CAT | V351I | ATT |
| A020Y | TAT | Q086N | AAT | K152P | CCT | W218S | TCG | E285K | AAG | V351L | TTG |
| P021A | GCG | Q086P | CCT | K152R | AGG | W218T | ACT | E285M | ATG | V351N | AAT |
| P021C | TGT | Q086R | CGG | K152S | TCT | W218V | GTG | E285N | AAT | V351Q | CAG |
| P021D | GAT | Q086S | TCT | K152T | ACT | N219A | GCG | E285P | CCT | V351R | AGG |
| P021E | GAG | Q086T | ACT | K152V | GTG | N219C | TGT | E285Q | CAG | V351S | TCT |
| P021G | GGG | Q086V | GTG | K152W | TGG | N219D | GAT | E285R | CGT | V351W | TGG |
| P021H | CAT | Q086W | TGG | K152Y | TAT | N219E | GAG | E285S | AGT | V351Y | TAT |
| P021I | ATT | D087A | GCT | A153C | TGT | N219G | GGG | E285T | ACG | C352A | GCT |
| P021K | AAG | D087C | TGT | A153E | GAG | N219H | CAT | E285V | GTG | C352D | GAT |
| P021L | CTT | D087E | GAG | A153F | TTT | N219I | ATT | E285W | TGG | C352E | GAG |
| P021M | ATG | D087G | GGG | A153G | GGT | N219K | AAG | E285Y | TAT | C352F | TTT |
| P021R | CGT | D087H | CAT | A153H | CAT | N219L | CTT | L286A | GCG | C352G | GGG |
| P021S | TCT | D087I | ATT | A153I | ATT | N219M | ATG | L286C | TGT | C352K | AAG |
| P021T | ACG | D087L | CTG | A153K | AAG | N219P | CCT | L286D | GAT | C352M | ATG |
| P021V | GTT | D087M | ATG | A153L | CTG | N219R | CGT | L286E | GAG | C352P | CCT |
| P021W | TGG | D087P | CCT | A153M | ATG | N219S | TCG | L286F | TTT | C352Q | CAG |
| S022A | GCT | D087Q | CAG | A153P | CCT | N219T | ACT | L286G | GGT | C352R | CGT |
| S022C | TGT | D087R | AGG | A153Q | CAG | N219W | TGG | L286H | CAT | C352S | AGT |
| S022D | GAT | D087S | TCG | A153R | CGT | E220A | GCG | L286K | AAG | C352T | ACT |
| S022E | GAG | D087T | ACT | A153S | AGT | E220D | GAT | L286M | ATG | C352V | GTG |
| S022G | GGG | D087V | GTT | A153T | ACT | E220G | GGG | L286P | CCT | C352W | TGG |
| S022H | CAT | D087Y | TAT | A153V | GTG | E220H | CAT | L286R | AGG | C352Y | TAT |
| S022K | AAG | H088A | GCT | A153W | TGG | E220I | ATT | L286S | AGT | I353A | GCT |
| S022L | CTG | H088C | TGT | K154A | GCT | E220K | AAG | L286T | ACG | I353C | TGT |
| S022M | ATG | H088E | GAG | K154C | TGT | E220L | TTG | L286W | TGG | I353E | GAG |
| S022N | AAT | H088F | TTT | K154D | GAT | E220M | ATG | L286Y | TAT | I353F | TTT |
| S022P | CCG | H088G | GGG | K154E | GAG | E220N | AAT | V287A | GCT | I353G | GGG |
| S022R | CGG | H088I | ATT | K154G | GGT | E220P | CCG | V287C | TGT | I353H | CAT |
| S022T | ACT | H088K | AAG | K154H | CAT | E220R | CGG | V287D | GAT | I353K | AAG |
| S022V | GTG | H088L | TTG | K154I | ATT | E220S | TCT | V287E | GAG | I353L | CTT |
| S022Y | TAT | H088M | ATG | K154L | CTG | E220T | ACG | V287F | TTT | I353M | ATG |
| E023A | GCT | H088P | CCT | K154P | CCT | E220V | GTG | V287G | GGG | I353Q | CAG |
| E023D | GAT | H088R | CGT | K154R | CGG | E220W | TGG | V287I | ATT | I353R | CGT |
| E023F | TTT | H088S | AGT | K154S | AGT | S221A | GCG | V287K | AAG | I353S | TCG |
| E023G | GGG | H088T | ACT | K154T | ACT | S221C | TGT | V287L | CTT | I353T | ACT |
| E023H | CAT | H088V | GTT | K154V | GTG | S221D | GAT | V287N | AAT | I353V | GTG |
| E023L | CTT | H088Y | TAT | K154W | TGG | S221E | GAG | V287P | CCT | I353W | TGG |
| E023M | ATG | L089A | GCT | K154Y | TAT | S221G | GGG | V287Q | CAG | R354C | TGT |
| E023N | AAT | L089C | TGT | Q155A | GCT | S221H | CAT | V287R | AGG | R354D | GAT |
| E023P | CCT | L089D | GAT | Q155C | TGT | S221I | ATT | V287S | TCT | R354E | GAG |
| E023Q | CAG | L089E | GAG | Q155D | GAT | S221K | AAG | V287T | ACT | R354G | GGT |
| E023R | CGG | L089G | GGG | Q155F | TTT | S221L | TTG | Y288D | GAC | R354H | CAT |
| E023S | TCT | L089K | AAG | Q155G | GGG | S221M | ATG | Y288E | GAG | R354I | ATT |
| E023T | ACG | L089M | ATG | Q155H | CAT | S221P | CCG | Y288F | TTT | R354K | AAG |
| E023V | GTG | L089N | AAT | Q155K | AAG | S221Q | CAG | Y288G | GGG | R354L | CTT |
| E023W | TGG | L089P | CCT | Q155L | CTT | S221R | CGG | Y288H | CAT | R354M | ATG |
| F024A | GCG | L089Q | CAG | Q155M | ATG | S221T | ACT | Y288I | ATT | R354P | CCT |
| F024C | TGT | L089R | AGG | Q155P | CCT | S221V | GTG | Y288K | AAG | R354Q | CAG |
| F024E | GAG | L089S | TCG | Q155R | CGG | T222A | GCG | Y288L | CTG | R354S | TCT |
| F024G | GGG | L089T | ACT | Q155S | AGT | T222D | GAT | Y288P | CCT | R354V | GTG |
| F024H | CAT | L089W | TGG | Q155T | ACT | T222E | GAG | Y288Q | CAG | R354W | TGG |
| F024I | ATT | L089Y | TAT | Q155V | GTT | T222F | TTT | Y288R | CGT | R354Y | TAT |
| F024K | AAG | D090A | GCT | Q155W | TGG | T222G | GGG | Y288S | TCT | K355D | GAT |
| F024L | TTG | D090C | TGT | Q155Y | TAT | T222I | ATT | Y288T | ACT | K355F | TTT |
| F024M | ATG | D090E | GAG | E156A | GCT | T222K | AAA | Y288V | GTG | K355G | GGG |
| F024N | AAT | D090G | GGG | E156C | TGT | T222L | TTG | Y288W | TGG | K355H | CAT |

TABLE 8-continued

PH20 Variants

| mut | cod | mut | cod | mut | cod | mut | cod | mut | cod | mut | cod |
|---|---|---|---|---|---|---|---|---|---|---|---|
| F024P | CCT | D090H | CAT | E156D | GAT | T222N | AAT | T289A | GCT | K355L | CTG |
| F024R | CGT | D090I | ATT | E156G | GGT | T222P | CCG | T289C | TGT | K355M | ATG |
| F024T | ACG | D090K | AAG | E156I | ATT | T222R | CGG | T289E | GAG | K355N | AAT |
| F024V | GTT | D090L | CTT | E156K | AAG | T222S | AGT | T289G | GGT | K355P | CCT |
| F024Y | TAT | D090N | AAT | E156L | CTG | T222V | GTT | T289H | CAT | K355Q | CAG |
| C025D | GAT | D090P | CCT | E156M | ATG | T222W | TGG | T289K | AAG | K355R | CGT |
| C025E | GAG | D090Q | CAG | E156P | CCT | T222Y | TAT | T289L | CTT | K355S | TCT |
| C025F | TTT | D090R | AGG | E156Q | CAG | A223C | TGT | T289M | ATG | K355T | ACT |
| C025G | GGG | D090S | AGT | E156R | CGG | A223D | GAT | T289N | AAT | K355V | GTG |
| C025H | CAT | D090T | ACT | E156S | TCT | A223E | GAG | T289P | CCT | K355W | TGG |
| C025I | ATT | D090W | TGG | E156T | ACT | A223G | GGG | T289Q | CAG | K355Y | TAT |
| C025K | AAG | K091A | GCT | E156V | GTT | A223H | CAT | T289R | AGG | N356A | GCT |
| C025L | TTG | K091D | GAT | E156W | TGG | A223K | AAG | T289S | TCG | N356C | TGT |
| C025N | AAT | K091E | GAG | F157A | GCT | A223L | CTG | T289V | GTG | N356D | GAT |
| C025P | CCT | K091F | TTT | F157C | TGT | A223P | CCT | T289Y | TAT | N356F | TTT |
| C025R | CGT | K091G | GGG | F157D | GAT | A223Q | CAG | F290A | GCT | N356G | GGG |
| C025S | TCT | K091H | CAT | F157E | GAG | A223R | AGG | F290C | TGT | N356H | CAT |
| C025T | ACT | K091I | ATT | F157G | GGT | A223S | TCT | F290D | GAT | N356K | AAG |
| C025V | GTG | K091L | TTG | F157H | CAT | A223T | ACG | F290G | GGG | N356L | CTG |
| C025Y | TAT | K091N | AAT | F157I | ATT | A223V | GTG | F290H | CAT | N356P | CCT |
| L026A | GCT | K091Q | CAG | F157K | AAG | A223W | TGG | F290I | ATT | N356Q | CAG |
| L026E | GAG | K091R | CGT | F157L | TTG | A223Y | TAT | F290K | AAG | N356R | CGG |
| L026G | GGT | K091S | TCT | F157M | ATG | L224A | GCT | F290L | TTG | N356S | AGT |
| L026H | CAT | K091T | ACT | F157P | CCT | L224D | GAT | F290M | ATG | N356T | ACT |
| L026I | ATT | K091Y | TAT | F157Q | CAG | L224E | GAG | F290Q | CAG | N356V | GTG |
| L026K | AAG | A092C | TGT | F157R | CGG | L224F | TTT | F290R | AGG | N356W | TGG |
| L026M | ATG | A092E | GAG | F157S | TCG | L224G | GGG | F290S | TCG | W357A | GCT |
| L026P | CCG | A092F | TTT | F157T | ACT | L224I | ATT | F290T | ACT | W357C | TGT |
| L026Q | CAG | A092G | GGT | F157V | GTG | L224M | ATG | F290V | GTT | W357D | GAT |
| L026R | CGG | A092H | CAT | F157W | TGG | L224P | CCG | F290Y | TAT | W357E | GAG |
| L026S | TCT | A092K | AAG | E158A | GCT | L224Q | CAG | G291A | GCT | W357F | TTT |
| L026T | ACT | A092L | CTG | E158C | TGT | L224R | AGG | G291C | TGT | W357G | GGG |
| L026V | GTT | A092M | ATG | E158D | GAT | L224S | AGT | G291D | GAT | W357K | AAG |
| L026W | TGG | A092P | CCT | E158F | TTT | L224T | ACT | G291E | GAG | W357L | TTG |
| L026Y | TAT | A092Q | CAG | E158G | GGG | L224V | GTT | G291F | TTT | W357M | ATG |
| G027A | GCT | A092R | CGT | E158H | CAT | L224W | TGG | G291H | CAT | W357P | CCT |
| G027C | TGT | A092T | ACT | E158K | AAG | L224Y | TAT | G291L | CTG | W357Q | CAG |
| G027D | GAT | A092V | GTT | E158L | CTG | Y225A | GCG | G291M | ATG | W357R | CGG |
| G027E | GAG | A092W | TGG | E158N | AAT | Y225D | GAT | G291N | AAT | W357S | AGT |
| G027F | TTT | A092Y | TAT | E158P | CCT | Y225E | GAG | G291P | CCT | W357T | ACT |
| G027H | CAT | K093D | GAT | E158Q | CAG | Y225G | GGT | G291Q | CAG | W357V | GTG |
| G027I | ATT | K093E | GAG | E158R | CGG | Y225H | CAT | G291R | CGT | N358C | TGT |
| G027K | AAG | K093F | TTT | E158S | TCG | Y225K | AAG | G291S | TCT | N358D | GAT |
| G027L | CTG | K093G | GGT | E158V | GTG | Y225L | CTG | G291T | ACT | N358E | GAG |
| G027P | CCT | K093H | CAT | E158Y | TAT | Y225P | CCG | G291V | GTG | N358G | GGG |
| G027Q | CAG | K093I | ATT | K159A | GCT | Y225Q | CAG | G291W | TGG | N358H | CAT |
| G027R | CGG | K093L | CTG | K159D | GAT | Y225R | AGG | G291Y | TAT | N358I | ATT |
| G027S | TCG | K093M | ATG | K159E | GAG | Y225S | TCT | E292A | GCT | N358K | AAG |
| G027T | ACT | K093N | AAT | K159F | TTT | Y225T | ACG | E292C | TGT | N358L | CTG |
| G027W | TGG | K093P | CCT | K159G | GGT | Y225V | GTG | E292F | TTT | N358P | CCT |
| K028A | GCG | K093Q | CAG | K159H | CAT | Y225W | TGG | E292G | GGT | N358Q | CAG |
| K028D | GAT | K093R | CGG | K159L | CTT | P226A | GCG | E292H | CAT | N358R | CGT |
| K028E | GAG | K093S | AGT | K159M | ATG | P226C | TGT | E292I | ATT | N358S | TCT |
| K028F | TTT | K093T | ACT | K159N | AAT | P226D | GAT | E292K | AAG | N358T | ACT |
| K028G | GGG | K093V | GTT | K159Q | CAG | P226E | GAG | E292L | TTG | N358V | GTG |
| K028I | ATT | K094A | GCT | K159R | CGG | P226F | TTT | E292N | AAT | N358W | TGG |
| K028L | TTG | K094C | TGT | K159S | TCT | P226G | GGT | E292P | CCT | S359A | GCT |
| K028M | ATG | K094D | GAT | K159V | GTG | P226L | CTT | E292Q | CAG | S359C | TGT |
| K028N | AAT | K094E | GAG | K159W | TGG | P226N | AAT | E292R | CGG | S359D | GAT |
| K028P | CCT | K094F | TTT | K159Y | TAT | P226Q | CAG | E292T | ACT | S359E | GAG |
| K028R | CGG | K094G | GGG | A160C | TGT | P226R | AGG | E292V | GTT | S359F | TTT |
| K028S | AGT | K094H | CAT | A160F | TTT | P226S | TCT | E292W | TGG | S359G | GGG |
| K028T | ACT | K094L | TTG | A160G | GGG | P226T | ACG | T293A | GCT | S359H | CAT |
| K028V | GTT | K094M | ATG | A160H | CAT | P226V | GTT | T293C | TGT | S359K | AAG |
| K028W | TGG | K094N | AAT | A160I | ATT | P226W | TGG | T293D | GAT | S359L | TTG |
| F029A | GCT | K094P | CCT | A160K | AAG | P226Y | TAT | T293E | GAG | S359M | ATG |
| F029C | TGT | K094Q | CAG | A160L | CTG | S227A | GCT | T293F | TTT | S359P | CCT |
| F029E | GAG | K094R | AGG | A160M | ATG | S227F | TTT | T293G | GGT | S359R | CGG |
| F029G | GGG | K094S | TCT | A160N | AAT | S227G | GGG | T293K | AAG | S359T | ACT |
| F029H | CAT | K094T | ACT | A160Q | CAG | S227H | CAT | T293L | CTT | S359V | GTT |
| F029I | ATT | D095A | GCT | A160R | AGG | S227I | ATT | T293M | ATG | S359W | TGG |
| F029K | AAG | D095C | TGT | A160S | AGT | S227K | AAG | T293N | AAT | S360A | GCT |
| F029L | CTT | D095E | GAG | A160V | GTG | S227L | TTG | T293P | CCT | S360C | TGT |
| F029M | ATG | D095F | TTT | A160W | TGG | S227M | ATG | T293Q | CAG | S360E | GAG |
| F029P | CCG | D095G | GGG | A160Y | TAT | S227P | CCT | T293S | TCT | S360F | TTT |
| F029R | CGG | D095H | CAT | G161A | GCT | S227Q | CAG | T293V | GTG | S360G | GGG |

TABLE 8-continued

PH20 Variants

| mut | cod | mut | cod | mut | cod | mut | cod | mut | cod | mut | cod |
|---|---|---|---|---|---|---|---|---|---|---|---|
| F029S | TCG | D095K | AAG | G161C | TGT | S227R | CGG | T293Y | TAT | S360I | ATT |
| F029T | ACG | D095L | TTG | G161D | GAT | S227T | ACG | V294A | GCT | S360K | AAG |
| F029V | GTG | D095M | ATG | G161E | GAG | S227V | GTG | V294C | TGT | S360L | CTG |
| F029W | TGG | D095P | CCT | G161H | CAT | S227W | TGG | V294E | GAG | S360M | ATG |
| D030A | GCG | D095Q | CAG | G161I | ATT | S227Y | TAT | V294G | GGG | S360N | AAT |
| D030E | GAG | D095S | TCT | G161K | AAG | I228A | GCG | V294H | CAT | S360P | CCT |
| D030F | TTT | D095V | GTG | G161L | CTT | I228E | GAG | V294K | AAG | S360Q | CAG |
| D030G | GGG | D095W | TGG | G161M | ATG | I228F | TTT | V294L | TTG | S360R | AGG |
| D030H | CAT | D095Y | TAT | G161Q | CAG | I228G | GGG | V294M | ATG | S360T | ACT |
| D030K | AAG | I096A | GCT | G161R | CGT | I228H | CAT | V294N | AAT | S360V | GTT |
| D030L | TTG | I096C | TGT | G161S | AGT | I228K | AAG | V294P | CCT | D361A | GCT |
| D030M | ATG | I096D | GAT | G161T | ACT | I228L | TTG | V294Q | CAG | D361C | TGT |
| D030P | CCT | I096E | GAG | G161V | GTG | I228M | ATG | V294R | AGG | D361E | GAG |
| D030Q | CAG | I096F | TTT | G161W | TGG | I228N | AAT | V294S | AGT | D361G | GGG |
| D030R | CGG | I096G | GGG | K162A | GCT | I228P | CCG | V294T | ACT | D361H | CAT |
| D030S | TCG | I096H | CAT | K162D | GAT | I228Q | CAG | V294W | TGG | D361L | TTG |
| D030T | ACT | I096L | TTG | K162E | GAG | I228R | CGT | A295C | TGT | D361M | ATG |
| D030V | GTT | I096N | AAT | K162F | TTT | I228S | TCT | A295D | GAT | D361N | AAT |
| D030W | TGG | I096P | CCT | K162G | GGG | I228T | ACT | A295E | GAG | D361P | CCT |
| E031A | GCG | I096R | CGT | K162H | CAT | I228W | TGG | A295F | TTT | D361Q | CAG |
| E031C | TGT | I096S | AGT | K162L | TTG | Y229E | GAG | A295G | GGG | D361R | AGG |
| E031G | GGG | I096T | ACT | K162M | ATG | Y229F | TTT | A295H | CAT | D361S | TCG |
| E031H | CAT | I096V | GTG | K162P | CCT | Y229G | GGT | A295I | ATT | D361V | GTT |
| E031I | ATT | I096W | TGG | K162Q | CAG | Y229H | CAT | A295L | CTG | D361W | TGG |
| E031K | AAG | T097A | GCT | K162R | CGG | Y229I | ATT | A295N | AAT | D361Y | TAT |
| E031L | CTG | T097C | TGT | K162S | TCG | Y229K | AAG | A295P | CCT | Y362A | GCT |
| E031N | AAC | T097D | GAT | K162V | GTG | Y229L | TTG | A295Q | CAG | Y362C | TGT |
| E031P | CCG | T097E | GAG | K162W | TGG | Y229N | AAT | A295S | AGT | Y362E | GAG |
| E031R | CGG | T097F | TTT | K162Y | TAT | Y229P | CCT | A295T | CCT | Y362G | GGG |
| E031S | TCT | T097G | GGG | D163A | GCT | Y229Q | CAG | A295V | GTT | Y362H | CAT |
| E031T | ACG | T097I | ATT | D163C | TGT | Y229R | CGT | A295Y | TAT | Y362K | AAG |
| E031V | GTG | T097L | CTT | D163E | GAG | Y229S | TCG | L296A | GCT | Y362L | CTT |
| E031W | TGG | T097N | AAT | D163F | TTT | Y229T | ACT | L296C | TGT | Y362M | ATG |
| E031Y | TAT | T097P | CCT | D163G | GGG | Y229V | GTG | L296F | TTT | Y362N | AAT |
| P032A | GCG | T097Q | CAG | D163H | CAC | Y229W | TGG | L296G | GGT | Y362P | CCT |
| P032C | TGT | T097R | CGG | D163K | AAG | L230A | GCG | L296I | ATT | Y362R | CGG |
| P032F | TTT | T097S | TCG | D163L | CTT | L230E | GAG | L296K | AAG | Y362S | AGT |
| P032G | GGG | T097W | TGG | D163P | CCT | L230G | GGG | L296M | ATG | Y362T | ACT |
| P032H | CAT | T097Y | TAT | D163Q | CAG | L230H | CAT | L296P | CCT | Y362V | GTG |
| P032K | AAG | F098A | GCT | D163R | AGG | L230I | ATT | L296Q | CAG | Y362W | TGG |
| P032L | CTG | F098C | TGT | D163S | TCG | L230K | AAG | L296R | CGT | L363A | GCT |
| P032M | ATG | F098D | GAT | D163T | ACT | L230M | ATG | L296S | TCG | L363D | GAT |
| P032N | AAT | F098E | GAG | D163V | GTG | L230N | AAT | L296T | ACT | L363E | GAG |
| P032Q | CAG | F098G | GGG | D163W | TGG | L230P | CCT | L296V | GTT | L363F | TTT |
| P032R | CGG | F098H | CAT | F164A | GCT | L230R | CGT | L296W | TGG | L363G | GGG |
| P032S | TCG | F098I | ATT | F164C | TGT | L230S | AGT | L296Y | TAT | L363H | CAT |
| P032T | ACT | F098L | TTG | F164D | GAT | L230T | ACT | G297A | GCT | L363I | ATT |
| P032V | GTG | F098M | ATG | F164E | GAG | L230V | GTT | G297C | TGT | L363P | CCT |
| P032W | TGG | F098P | CCT | F164G | GGG | L230W | TGG | G297E | GAG | L363Q | CAG |
| P032Y | TAT | F098Q | CAG | F164H | CAT | L230Y | TAT | G297H | CAT | L363R | CGG |
| L033C | TGT | F098R | CGT | F164L | TTG | N231A | GCT | G297I | ATT | L363S | TCG |
| L033D | GAT | F098S | TCG | F164M | ATG | N231C | TGT | G297L | CTT | L363T | ACT |
| L033G | GGG | F098V | GTT | F164N | AAT | N231D | GAT | G297N | AAT | L363V | GTG |
| L033H | CAT | F098W | TGG | F164P | CCT | N231F | TTT | G297P | CCT | L363W | TGG |
| L033I | ATT | Y099A | GCT | F164Q | CAG | N231G | GGG | G297Q | CAG | H364A | GCT |
| L033M | ATG | Y099C | TGT | F164R | CGG | N231H | CAT | G297R | CGG | H364C | TGT |
| L033N | AAT | Y099E | GAG | F164S | AGT | N231I | ATT | G297S | AGT | H364D | GAT |
| L033P | CCG | Y099F | TTT | F164V | GTT | N231K | AAG | G297T | ACT | H364E | GAG |
| L033Q | CAG | Y099G | GGT | F164W | TGG | N231L | CTT | G297V | GTG | H364F | TTT |
| L033R | AGG | Y099I | ATT | L165A | GCT | N231P | CCT | G297W | TGG | H364G | GGG |
| L033S | TCG | Y099L | TTG | L165C | TGT | N231Q | CAG | G297Y | TAT | H364K | AAG |
| L033T | ACT | Y099N | AAT | L165D | GAT | N231R | CGT | A298C | TGT | H364L | CTG |
| L033V | GTT | Y099P | CCT | L165F | TTT | N231S | TCT | A298E | GAG | H364M | ATG |
| L033W | TGG | Y099Q | CAG | L165G | GGG | N231T | ACG | A298G | GGG | H364S | TCT |
| L033Y | TAT | Y099R | AGG | L165H | CAT | N231V | GTG | A298I | ATT | H364P | CCT |
| D034A | GCT | Y099S | TCG | L165N | AAT | T232A | GCG | A298L | TTG | H364R | CGG |
| D034E | GAG | Y099T | ACT | L165P | CCT | T232C | TGT | A298M | ATG | H364S | TCT |
| D034G | GGT | Y099V | GTT | L165Q | CAG | T232F | TTT | A298N | AAT | H364T | ACT |
| D034H | CAT | Y099W | TGG | L165R | CGG | T232G | GGG | A298P | CCT | H364V | GTG |
| D034I | ATT | M100C | TGT | L165S | TCG | T232H | CAT | A298Q | CAG | H364Y | TAT |
| D034K | AAG | M100E | GAG | L165T | ACT | T232K | AAG | A298R | CGT | L365A | GCT |
| D034L | CTT | M100F | TTT | L165V | GTG | T232L | CTT | A298S | TCG | L365C | TGT |
| D034N | AAT | M100G | GGT | L165W | TGG | T232M | ATG | A298T | ACT | L365D | GAT |
| D034P | CCT | M100K | AAG | L165Y | TAT | T232N | AAT | A298V | GTG | L365E | GAG |
| D034Q | CAG | M100L | CTG | V166A | GCT | T232P | CCG | A298W | TGG | L365G | GGG |
| D034R | CGT | M100N | AAT | V166C | TGT | T232Q | CAG | A298Y | TAT | L365I | ATT |

TABLE 8-continued

PH20 Variants

| mut | cod | mut | cod | mut | cod | mut | cod | mut | cod | mut | cod |
|---|---|---|---|---|---|---|---|---|---|---|---|
| D034S | AGT | M100P | CCT | V166D | GAT | T232R | AGG | S299A | GCT | L365M | ATG |
| D034T | ACG | M100Q | CAG | V166E | GAG | T232S | AGT | S299C | TGT | L365N | AAT |
| D034V | GTT | M100R | CGG | V166F | TTT | T232V | GTG | S299D | GAT | L365P | CCT |
| D034W | TGG | M100S | TCT | V166G | GGT | T232Y | TAT | S299E | GAG | L365Q | CAG |
| M035A | GCG | M100T | ACT | V166H | CAT | Q233A | GCG | S299F | TTT | L365R | CGG |
| M035D | GAT | M100V | GTT | V166L | CTT | Q233C | TGT | S299G | GGG | L365S | AGT |
| M035F | TTT | M100W | TGG | V166N | AAT | Q233D | GAT | S299H | CAT | L365T | ACT |
| M035G | GGG | M100Y | TAT | V166P | CCT | Q233F | TTT | S299I | ATT | L365V | GTG |
| M035H | CAT | P101A | GCT | V166Q | CAG | Q233G | GGG | S299L | CTT | L365W | TGG |
| M035I | ATT | P101C | TGT | V166R | CGG | Q233I | ATT | S299M | ATG | L365Y | TAT |
| M035L | TTG | P101F | TTT | V166T | ACT | Q233K | AAG | S299P | CCT | N366A | GCT |
| M035N | AAT | P101G | GGG | V166W | TGG | Q233L | CTG | S299Q | CAG | N366C | TGT |
| M035P | CCG | P101H | CAT | V166Y | TAT | Q233P | CCG | S299R | AGG | N366E | GAG |
| M035Q | CAG | P101I | ATT | E167A | GCT | Q233R | AGG | S299T | ACT | N366F | TTT |
| M035R | CGT | P101K | AAG | E167D | GAT | Q233S | TCG | S299Y | TAT | N366G | GGG |
| M035S | TCT | P101L | CTT | E167F | TTT | Q233T | ACG | G300A | GCT | N366K | AAG |
| M035T | ACT | P101M | ATG | E167G | GGT | Q233V | GTG | G300C | TGT | N366L | TTG |
| M035V | GTT | P101N | AAT | E167H | CAT | Q233W | TGG | G300D | GAT | N366M | ATG |
| M035Y | TAT | P101Q | CAG | E167K | AAG | Q233Y | TAT | G300E | GAG | N366P | CCT |
| S036A | GCG | P101R | AGG | E167L | TTG | Q234A | GCT | G300F | TTT | N366Q | CAG |
| S036C | TGT | P101S | TCT | E167M | ATG | Q234C | TGT | G300L | CTT | N366R | AGG |
| S036D | GAT | P101T | ACT | E167N | AAT | Q234D | GAT | G300M | ATG | N366S | TCT |
| S036F | TTT | P101Y | TAT | E167P | CCT | Q234E | GAG | G300N | AAT | N366T | ACT |
| S036G | GGT | V102A | GCT | E167R | AGG | Q234G | GGT | G300P | CCT | N366V | GTT |
| S036H | CAT | V102C | TGT | E167S | TCG | Q234H | CAT | G300Q | CAG | N366W | TGG |
| S036K | AAG | V102E | GAG | E167T | ACT | Q234L | CTT | G300R | AGG | P367A | GCT |
| S036L | TTG | V102G | GGT | E167V | GTT | Q234M | ATG | G300S | TCG | P367C | TGT |
| S036N | AAT | V102H | CAT | E167Y | TAT | Q234N | AAT | G300T | ACT | P367E | GAG |
| S036P | CCG | V102K | AAG | T168A | GCT | Q234P | CCG | G300V | GTT | P367F | TTT |
| S036R | CGG | V102L | TTG | T168C | TGT | Q234R | CGG | G300W | TGG | P367G | GGT |
| S036T | ACG | V102M | ATG | T168D | GAT | Q234S | AGT | I301A | GCT | P367H | CAT |
| S036V | GTT | V102N | AAT | T168E | GAG | Q234T | ACT | I301E | GAG | P367I | ATT |
| S036W | TGG | V102P | CCT | T168F | TTT | Q234V | GTG | I301G | GGG | P367K | AAG |
| S036Y | TAT | V102Q | CAG | T168G | GGG | Q234W | TGG | I301H | CAT | P367L | CTG |
| L037A | GCG | V102R | AGG | T168H | CAT | S235A | GCG | I301K | AAG | P367M | ATG |
| L037C | TGT | V102S | TCT | T168K | AAG | S235E | GAG | I301L | CTG | P367Q | CAG |
| L037E | GAG | V102T | ACT | T168L | CTG | S235F | TTT | I301M | ATG | P367R | CGT |
| L037F | TTT | V102W | TGG | T168P | CCT | S235G | GGG | I301N | AAT | P367S | TCG |
| L037G | GGG | D103A | GCT | T168R | CGG | S235H | CAT | I301P | CCT | P367V | GTT |
| L037I | ATT | D103E | GAG | T168S | TCT | S235K | AAG | I301Q | CAG | P367W | TGG |
| L037K | AAG | D103F | TTT | T168V | GTG | S235L | CTT | I301R | CGG | D368A | GCT |
| L037M | ATG | D103G | GGG | T168W | TGG | S235M | ATG | I301S | AGT | D368C | TGT |
| L037N | AAT | D103H | CAT | T168Y | TAT | S235P | CCT | I301V | GTT | D368E | GAG |
| L037P | CCT | D103I | ATT | I169A | GCT | S235Q | CAG | I301W | TGG | D368G | GGT |
| L037R | AGG | D103L | CTT | I169D | GAT | S235R | CGG | I301Y | TAT | D368H | CAT |
| L037S | TCT | D103N | AAT | I169F | TTT | S235T | ACG | V302C | TGT | D368K | AAG |
| L037T | ACG | D103Q | CAG | I169G | GGG | S235V | GTG | V302D | GAT | D368L | CTT |
| L037V | GTG | D103R | AGG | I169H | CAT | S235W | TGG | V302E | GAG | D368M | ATG |
| L037W | TGG | D103S | TCG | I169K | AAG | S235Y | TAT | V302F | TTT | D368P | CCT |
| F038A | GCG | D103T | ACT | I169L | TTG | P236A | CCG | V302G | GGT | D368R | CGT |
| F038C | TGT | D103V | GTT | I169N | AAT | P236C | TGT | V302H | CAT | D368S | AGT |
| F038E | GAG | D103W | TGG | I169P | CCT | P236E | GAG | V302I | ATT | D368T | ACT |
| F038G | GGG | D103Y | TAT | I169Q | CAG | P236G | GGG | V302L | TTG | D368V | GTT |
| F038K | AAG | N104A | GCT | I169R | CGG | P236H | CAT | V302M | ATG | D368W | TGG |
| F038L | CTT | N104C | TGT | I169S | TCG | P236I | ATT | V302P | CCT | D368Y | TAT |
| F038M | ATG | N104F | TTT | I169T | ACT | P236K | AAG | V302R | AGG | N369A | GCT |
| F038N | AAT | N104G | GGG | I169V | GTT | P236L | CTG | V302S | TCG | N369C | TGT |
| F038P | CCT | N104H | CAT | I169Y | TAT | P236N | AAT | V302T | ACT | N369E | GAG |
| F038Q | CAG | N104I | ATT | K170A | GCT | P236Q | CAG | V302W | TGG | N369F | TTT |
| F038R | AGG | N104K | AAG | K170C | TGT | P236R | CGT | V302Y | TAT | N369H | CAT |
| F038S | TCT | N104L | CTG | K170D | GAT | P236S | AGT | I303A | GCT | N369I | ATT |
| F038T | ACT | N104M | ATG | K170E | GAG | P236T | ACT | I303C | TGT | N369K | AAG |
| F038W | TGG | N104P | CCT | K170G | GGG | P236W | TGG | I303D | GAT | N369L | CTT |
| F038Y | TAT | N104R | AGG | K170I | ATT | P236Y | TAT | I303E | GAG | N369P | CCT |
| S039A | GCG | N104S | TCT | K170L | TTG | V237A | GCG | I303F | TTT | N369Q | CAG |
| S039C | TGT | N104T | ACT | K170M | ATG | V237C | TGT | I303G | GGT | N369R | CGG |
| S039D | GAT | N104V | GTT | K170N | AAT | V237E | GAG | I303K | AAG | N369S | TCG |
| S039F | TTT | N104W | TGG | K170P | CCT | V237F | TTT | I303L | TTG | N369T | ACT |
| S039G | GGT | L105A | GCT | K170Q | CAG | V237G | GGT | I303M | ATG | N369V | GTG |
| S039L | TTG | L105C | TGT | K170R | CGT | V237H | CAT | I303P | CCT | N369W | TGG |
| S039M | ATG | L105D | GAT | K170V | GTT | V237L | TTG | I303R | CGT | F370A | GCT |
| S039N | AAT | L105E | GAG | K170W | TGG | V237N | AAT | I303S | AGT | F370D | GAT |
| S039P | CCG | L105G | GGT | K170Y | TAT | V237P | CCT | I303V | GTG | F370E | GAG |
| S039Q | CAG | L105H | CAT | L171A | GCT | V237Q | CAG | I303W | TGG | F370G | GGG |
| S039R | CGT | L105I | ATT | L171C | TGT | V237R | CGG | I303Y | TAT | F370H | CAT |
| S039T | ACT | L105M | ATG | L171D | GAT | V237S | TCG | W304A | GCT | F370I | ATT |

TABLE 8-continued

PH20 Variants

| mut | cod | mut | cod | mut | cod | mut | cod | mut | cod | mut | cod |
|---|---|---|---|---|---|---|---|---|---|---|---|
| S039V | GTT | L105N | AAT | L171G | GGG | V237T | ACG | W304C | TGT | F370K | AAG |
| S039W | TGG | L105P | CCT | L171H | CAT | V237W | TGG | W304D | GAT | F370L | CTG |
| S039Y | TAT | L105Q | CAG | L171I | ATT | V237Y | TAT | W304G | GGT | F370N | AAT |
| F040A | GCG | L105R | CGG | L171M | ATG | A238D | GAT | W304I | ATT | F370P | CCT |
| F040D | GAT | L105S | TCT | L171N | AAT | A238E | GAG | W304L | CTG | F370Q | CAG |
| F040E | GAG | L105T | ACT | L171P | CCT | A238F | TTT | W304M | ATG | F370R | AGG |
| F040G | GGT | L105V | GTT | L171Q | CAG | A238G | GGT | W304N | AAT | F370S | TCT |
| F040I | ATT | L105W | TGG | L171R | CGT | A238H | CAT | W304P | CCT | F370V | GTG |
| F040K | AAG | G106A | GCT | L171S | AGT | A238K | AAG | W304Q | CAG | F370Y | TAT |
| F040L | CTG | G106C | TGT | L171V | GTG | A238L | CTT | W304R | CGG | A371C | TGT |
| F040N | AAT | G106D | GAT | L171W | TGG | A238P | CCG | W304S | AGT | A371E | GAG |
| F040Q | CAG | G106E | GAG | L171Y | TAT | A238Q | CAG | W304T | ACT | A371F | TTT |
| F040R | CGG | G106F | TTT | G172A | GCT | A238R | AGG | W304V | GTG | A371G | GGG |
| F040S | TCT | G106H | CAT | G172C | TGT | A238S | AGT | W304Y | TAT | A371H | CAT |
| F040T | ACT | G106I | ATT | G172D | GAT | A238T | ACG | G305C | TGT | A371I | ATT |
| F040V | GTT | G106L | CTG | G172E | GAG | A238V | GTG | G305D | GAT | A371K | AAG |
| F040W | TGG | G106M | ATG | G172I | ATT | A238W | TGG | G305E | GAG | A371L | CTT |
| F040Y | TAT | G106N | AAT | G172L | CTT | A238Y | TAT | G305F | TTT | A371M | ATG |
| I041A | GCG | G106P | CCT | G172M | ATG | A239C | TGT | G305H | CAT | A371P | CCT |
| I041C | TGT | G106S | AGT | G172P | CCT | A239F | TTT | G305K | AAG | A371R | CGT |
| I041D | GAT | G106T | ACG | G172Q | CAG | A239G | GGT | G305L | CTT | A371S | TCG |
| I041E | GAG | G106V | GTG | G172R | CGT | A239H | CAT | G305N | AAT | A371T | ACT |
| I041F | TTT | G106W | TGG | G172S | TCT | A239I | ATT | G305P | CCT | A371V | GTG |
| I041G | GGG | G106Y | TAT | G172T | ACT | A239K | AAG | G305Q | CAG | A371W | TGG |
| I041H | CAT | M107A | GCT | G172V | GTT | A239L | TTG | G305R | CGT | I372A | GCT |
| I041N | AAT | M107C | TGT | G172W | TGG | A239N | AAT | G305S | TCG | I372D | GAT |
| I041P | CCG | M107D | GAT | G172Y | TAT | A239P | CCT | G305T | ACT | I372E | GAG |
| I041Q | CAG | M107F | TTT | K173D | GAT | A239R | AGG | G305V | GTG | I372F | TTT |
| I041R | AGG | M107G | GGG | K173E | GAG | A239S | TCT | G305Y | TAT | I372G | GGT |
| I041S | TCT | M107H | CAT | K173G | GGG | A239T | ACT | T306A | GCT | I372H | CAT |
| I041T | ACG | M107I | ATT | K173H | CAT | A239V | GTT | T306C | TGT | I372K | AAG |
| I041V | GTT | M107K | AAG | K173I | ATT | A239W | CTT | T306D | GAT | I372L | CTG |
| I041W | TGG | M107L | CTT | K173L | CTT | A239Y | TAT | T306E | GAG | I372N | AAT |
| G042A | GCT | M107P | CCT | K173M | ATG | T240A | GCG | T306F | TTT | I372P | CCT |
| G042C | TGT | M107Q | CAG | K173N | AAT | T240E | GAG | T306G | GGT | I372R | CGG |
| G042D | GAT | M107R | CGT | K173P | CCT | T240F | TTT | T306H | CAT | I372S | TCT |
| G042E | GAG | M107S | TCT | K173Q | CAG | T240G | GGT | T306I | ATT | I372T | ACT |
| G042H | CAT | M107V | GTT | K173R | CGG | T240L | CTT | T306L | CTG | I372V | GTG |
| G042I | ATT | M107W | TGG | K173S | TCG | T240M | ATG | T306P | CCT | I372W | TGG |
| G042K | AAG | A108D | GAT | K173V | GTG | T240N | AAT | T306R | AGG | Q373A | GCT |
| G042L | CTG | A108E | GAG | K173W | TGG | T240P | CCT | T306S | AGT | Q373C | TGT |
| G042M | ATG | A108F | TTT | K173Y | TAT | T240Q | CAG | T306V | GTG | Q373E | GAG |
| G042P | CCT | A108G | GGT | L174A | GCT | T240R | CGT | T306W | TGG | Q373F | TTT |
| G042Q | CAG | A108H | CAT | L174C | TGT | T240S | AGT | T306Y | TAT | Q373G | GGT |
| G042R | CGG | A108K | AAG | L174G | GGG | T240V | GTG | L307C | TGT | Q373H | CAT |
| G042S | TCT | A108L | TTG | L174H | CAT | T240W | TGG | L307E | GAG | Q373K | AAG |
| G042T | ACT | A108M | ATG | L174K | AAG | T240Y | TAT | L307F | TTT | Q373L | CTG |
| G042V | GTT | A108N | AAT | L174M | ATG | L241A | GCG | L307G | GGG | Q373M | ATG |
| S043A | GCG | A108P | CCT | L174N | AAT | L241C | TGT | L307I | ATT | Q373N | AAT |
| S043D | GAT | A108Q | CAG | L174P | CCG | L241D | GAT | L307K | AAG | Q373P | CCT |
| S043E | GAG | A108R | CGG | L174Q | CAG | L241E | GAG | L307N | AAT | Q373R | CGT |
| S043F | TTT | A108S | TCT | L174R | CGT | L241F | TTT | L307P | CCT | Q373S | TCT |
| S043G | GGT | A108T | ACT | L174S | TCG | L241G | GGT | L307Q | CAG | Q373T | ACT |
| S043H | CAT | A108V | GTG | L174T | ACT | L241H | CAT | L307R | AGG | Q373V | GTT |
| S043I | ATT | A108Y | TAT | L174V | GTT | L241I | ATT | L307S | AGT | Q373W | TGG |
| S043K | AAG | V109A | GCT | L174W | TGG | L241K | AAG | L307T | ACT | L374A | GCT |
| S043L | CTT | V109C | TGT | L174Y | TAT | L241P | CCT | L307V | GTG | L374D | GAT |
| S043N | AAT | V109D | GAT | L175C | TGT | L241Q | CAG | L307W | TGG | L374E | GAG |
| S043P | CCT | V109E | GAG | L175D | GAT | L241R | CGG | L307Y | TAT | L374G | GGT |
| S043Q | CAG | V109F | TTT | L175E | GAG | L241S | TCT | S308C | TGT | L374H | CAT |
| S043R | CGG | V109G | GGG | L175F | TTT | L241T | ACG | S308D | GAT | L374I | ATT |
| S043T | ACT | V109H | CAT | L175G | GGG | L241V | GTT | S308F | TTT | L374M | ATG |
| S043V | GTG | V109L | TTG | L175H | CAT | L241W | TGG | S308G | GGG | L374N | AAT |
| P044A | GCT | V109M | ATG | L175K | AAG | Y242A | GCG | S308H | CAT | L374P | CCT |
| P044C | TGT | V109P | CCT | L175N | AAT | Y242C | TGT | S308K | AAG | L374R | AGG |
| P044E | GAG | V109Q | CAG | L175P | CCT | Y242D | GAT | S308L | CTG | L374S | AGT |
| P044F | TTT | V109R | AGG | L175R | CGT | Y242F | TTT | S308M | ATG | L374T | ACT |
| P044G | GGG | V109T | ACT | L175S | TCT | Y242G | GGT | S308N | AAT | L374V | GTG |
| P044H | CAT | V109W | TGG | L175T | ACT | Y242I | ATT | S308P | CCT | L374W | TGG |
| P044I | ATT | V109Y | TAT | L175V | GTG | Y242K | AAG | S308R | CGG | L374Y | TAT |
| P044L | CTT | I110A | GCT | L175W | TGG | Y242L | CTT | S308T | ACT | E375A | GCT |
| P044N | AAT | I110C | TGT | L175Y | TAT | Y242M | ATG | S308V | GTT | E375C | TGT |
| P044Q | CAG | I110D | GAT | R176A | GCT | Y242P | CCG | S308W | TGG | E375F | TTT |
| P044R | CGT | I110F | TTT | R176C | TGT | Y242R | CGG | S308Y | TAT | E375G | GGT |
| P044S | TCT | I110G | GGG | R176E | GAG | Y242S | TCT | I309D | GAT | E375I | ATT |
| P044T | ACT | I110H | CAT | R176F | TTT | Y242T | ACG | I309E | GAG | E375K | AAG |

TABLE 8-continued

PH20 Variants

| mut | cod | mut | cod | mut | cod | mut | cod | mut | cod | mut | cod |
|---|---|---|---|---|---|---|---|---|---|---|---|
| P044W | TGG | I110L | CTG | R176G | GGG | Y242V | GTT | I309G | GGT | E375L | CTT |
| P044Y | ACG | I110M | ATG | R176H | CAT | Y242W | TGG | I309H | CAT | E375M | ATG |
| R045A | GCG | I110N | AAT | R176I | ATT | V243A | GCG | I309K | AAG | E375N | AAT |
| R045D | GAT | I110P | CCT | R176K | AAG | V243C | TGT | I309L | CTG | E375P | CCT |
| R045F | TTT | I110R | CGT | R176L | CTT | V243D | GAT | I309M | ATG | E375R | CGT |
| R045G | GGG | I110S | AGT | R176P | CCT | V243F | TTT | I309N | AAT | E375S | TCT |
| R045H | CAT | I110V | GTT | R176Q | CAG | V243G | GGG | I309Q | CAG | E375T | ACT |
| R045I | ATT | I110W | TGG | R176S | AGT | V243H | CAT | I309R | CGT | E375V | GTT |
| R045K | AAG | D111C | TGT | R176T | ACT | V243L | CTT | I309S | AGT | E375Y | TAT |
| R045M | ATG | D111E | GAG | R176V | GTG | V243M | ATG | I309T | ACT | K376A | GCT |
| R045P | CCT | D111G | GGT | R176W | TGG | V243P | CCT | I309V | GTG | K376D | GAT |
| R045Q | CAG | D111H | CAT | P177A | GCT | V243Q | CAG | I309W | TGG | K376E | GAG |
| R045S | TCG | D111I | ATT | P177C | TGT | V243R | AGG | I309Y | TAT | K376G | GGG |
| R045T | ACG | D111K | AAG | P177D | GAT | V243S | AGT | M310A | GCT | K376I | ATT |
| R045V | GTG | D111L | TTG | P177F | TTT | V243T | ACG | M310C | TGT | K376L | TTG |
| R045W | TGG | D111M | ATG | P177G | GGG | V243W | TGG | M310E | GAG | K376M | ATG |
| R045Y | TAT | D111P | ACT | P177H | CAT | V243Y | TAT | M310F | TTT | K376P | CCT |
| I046A | GCG | D111Q | CAG | P177L | CTT | R244A | GCG | M310G | GGG | K376Q | CAG |
| I046C | TGT | D111R | CGG | P177M | ATG | R244D | GAT | M310K | AAG | K376R | CGT |
| I046E | GAG | D111S | AGT | P177Q | CAG | R244G | GGG | M310L | CTG | K376S | AGT |
| I046F | TTT | D111T | ACT | P177R | CGG | R244H | CAT | M310N | AAT | K376T | ACT |
| I046H | CAT | D111V | GTT | P177S | TCT | R244I | ATT | M310P | CCT | K376V | GTG |
| I046L | CTT | D111W | TGG | P177T | ACT | R244K | AAG | M310Q | CAG | K376W | TGG |
| I046M | ATG | D111Y | TAT | P177V | GTT | R244M | ATG | M310R | CGG | K376Y | TAT |
| I046N | AAT | W112C | TGT | P177W | TGG | R244N | AAT | M310S | AGT | G377C | TGT |
| I046P | CCT | W112D | GAT | P177Y | TAT | R244P | CCT | M310V | GTG | G377D | GAT |
| I046R | CGT | W112E | GAG | N178A | GCT | R244Q | CAG | M310W | TGG | G377E | GAG |
| I046S | TCT | W112F | TTT | N178D | GAT | R244S | TCT | M310Y | TAT | G377F | TTT |
| I046T | ACT | W112G | GGG | N178E | GAG | R244T | ACG | R311A | GCT | G377H | CAT |
| I046V | GTT | W112H | CAT | N178G | GGG | R244V | GTG | R311C | TGT | G377I | ATT |
| I046W | TGG | W112I | ATT | N178I | ATT | R244W | TGG | R311E | GAG | G377K | AAG |
| I046Y | TAT | W112L | CTT | N178K | AAG | R244Y | TAT | R311F | TTT | G377L | CTT |
| N047A | GCT | W112N | AAT | N178L | TTG | N245A | GCG | R311G | GGT | G377M | ATG |
| N047D | GAT | W112P | CCT | N178M | ATG | N245C | TGT | R311H | CAT | G377P | CCT |
| N047F | TTT | W112Q | CAG | N178P | CCT | N245F | TTT | R311I | ATT | G377R | AGG |
| N047G | GGG | W112R | CGT | N178R | CGG | N245G | GGG | R311K | AAG | G377S | TCG |
| N047H | CAT | W112S | TCT | N178S | AGT | N245H | CAT | R311L | TTG | G377T | ACT |
| N047I | ATT | W112V | GTT | N178T | ACT | N245I | ATT | R311P | CCT | G377V | GTG |
| N047K | AAG | W112Y | TAT | N178V | GTG | N245K | AAG | R311Q | CAG | G377Y | TAT |
| N047L | CTT | E113A | GCT | N178W | TGG | N245L | CTG | R311S | TCT | G378D | GAT |
| N047M | ATG | E113C | TGT | N178Y | TAT | N245P | CCG | R311T | ACT | G378E | GAG |
| N047P | CCT | E113D | GAT | H179A | GCT | N245Q | CAG | R311V | GTG | G378F | TTT |
| N047Q | CAG | E113F | TTT | H179C | TGT | N245R | CGG | R311W | TGG | G378I | ATT |
| N047R | CGG | E113G | GGG | H179E | GAG | N245S | TCG | S312A | GCT | G378K | AAG |
| N047S | TCT | E113H | CAT | H179G | GGG | N245T | ACG | S312C | TGT | G378L | CTG |
| N047T | ACG | E113I | CTT | H179I | ATT | N245V | GTG | S312E | GAG | G378M | ATG |
| N047V | GTG | E113P | CCT | H179K | AAG | N245W | TGG | S312F | TTT | G378N | AAT |
| N047W | TGG | E113Q | CAG | H179L | CTG | R246A | GCG | S312G | GGG | G378Q | CAG |
| N047Y | TAT | E113R | CGT | H179M | ATG | R246C | TGT | S312H | CAT | G378R | AGG |
| A048C | TGT | E113S | TCT | H179N | AAT | R246D | GAT | S312K | AAG | G378S | TCT |
| A048E | GAG | E113T | ACT | H179P | CCT | R246E | GAG | S312L | CTG | G378T | ACT |
| A048F | TTT | E113V | GTT | H179R | AGG | R246G | GGG | S312M | ATG | G378V | GTG |
| A048G | GGT | E113W | TGG | H179S | AGT | R246H | CAT | S312N | AAT | G378W | TGG |
| A048H | CAT | E113Y | CAT | H179T | ACT | R246I | ATT | S312P | CCT | G378Y | TAT |
| A048I | ATT | E114A | GCT | H179V | GTG | R246K | AAG | S312Q | CAG | K379A | GCT |
| A048K | AAG | E114C | TGT | H179W | TGG | R246L | TTG | S312R | CGG | K379C | TGT |
| A048L | CTG | E114D | GAT | L180A | GCT | R246M | ATG | S312T | ACT | K379E | GAG |
| A048M | ATG | E114G | GGG | L180C | TGT | R246P | CCT | S312V | GTT | K379F | TTT |
| A048N | AAT | E114H | CAT | L180E | GAG | R246S | AGT | S312W | TGG | K379G | GGG |
| A048P | CCT | E114I | ATT | L180F | TTT | R246T | ACG | M313A | GCT | K379H | CAT |
| A048Q | CAG | E114L | CTG | L180G | GGT | R246V | GTT | M313C | TGT | K379I | ATT |
| A048R | CGG | E114M | ATG | L180H | CAT | R246W | TGG | M313D | GAT | K379L | CTT |
| A048S | TCT | E114P | CCT | L180I | ATT | V247A | GCG | M313E | GAG | K379M | ATG |
| A048V | GTT | E114R | CGG | L180K | AAG | V247C | TGT | M313F | TTT | K379N | AAT |
| A048W | TGG | E114S | TCT | L180M | ATG | V247F | TTT | M313G | GGG | K379R | CGT |
| A048Y | TAT | E114T | ACT | L180N | AAT | V247H | CAT | M313H | CAT | K379S | TCT |
| T049A | GCG | E114V | GTG | L180P | CCT | V247I | ATT | M313K | AAG | K379T | ACT |
| T049C | TGT | E114W | TGG | L180R | AGG | V247L | CTG | M313L | CTT | K379V | GTT |
| T049D | GAT | E114Y | TAT | L180S | TCG | V247M | ATG | M313P | CCT | K379W | TGG |
| T049F | TTT | W115A | GCT | L180T | ACT | V247N | AAT | M313R | CGT | F380A | GCT |
| T049G | GGG | W115C | TGT | L180W | TGG | V247P | CCT | M313S | TCG | F380C | TGT |
| T049H | CAT | W115D | GAT | W181A | GCT | V247Q | CAG | M313T | ACT | F380D | GAT |
| T049I | ATT | W115F | TTT | W181C | TGT | V247R | CGT | M313V | GTT | F380E | GAG |
| T049K | AAG | W115G | GGT | W181D | GAT | V247S | TCT | M313Y | TAT | F380G | GGG |
| T049L | TTG | W115H | CAT | W181E | GAG | V247T | ACT | K314A | GCT | F380I | ATT |
| T049N | AAT | W115I | ATT | W181F | TTT | V247W | TGG | K314C | TGT | F380L | CTT |

TABLE 8-continued

PH20 Variants

| mut | cod | mut | cod | mut | cod | mut | cod | mut | cod | mut | cod |
|---|---|---|---|---|---|---|---|---|---|---|---|
| T049P | CCG | W115K | AAG | W181H | CAT | V247Y | TAT | K314D | GAT | F380P | CCT |
| T049R | AGG | W115L | CTT | W181I | ATT | R248A | GCT | K314H | CAT | F380Q | CAG |
| T049S | TCG | W115M | ATG | W181K | AAG | R248C | TGT | K314I | ATT | F380R | CGG |
| T049V | GTT | W115P | CCT | W181L | CTG | R248D | GAT | K314L | TTG | F380S | AGT |
| T049W | TGG | W115R | CGG | W181M | ATG | R248E | GAG | K314N | AAT | F380T | ACT |
| G050A | GCG | W115S | AGT | W181N | AAT | R248G | GGG | K314P | CCT | F380V | GTG |
| G050C | TGT | W115V | GTG | W181Q | CAG | R248H | CAT | K314Q | CAG | F380W | TGG |
| G050D | GAT | W115Y | TAT | W181R | CGT | R248I | ATT | K314R | CGG | F380Y | TAT |
| G050E | GAG | R116A | GCT | W181S | TCT | R248L | CTT | K314S | TCG | T381A | AGC |
| G050F | TTT | R116C | TGT | W181V | GTG | R248M | ATG | K314T | ACT | T381E | GAG |
| G050H | CAT | R116D | GAT | G182A | GCT | R248P | CCG | K314V | GTT | T381F | TTT |
| G050L | CTT | R116E | GAG | G182C | TGT | R248S | TCG | K314W | TGG | T381G | GGT |
| G050M | ATG | R116G | GGG | G182D | GAT | R248T | ACG | K314Y | TAT | T381H | CAT |
| G050P | CCT | R116H | CAT | G182E | GAG | R248V | GTG | S315A | GCT | T381K | AAG |
| G050Q | CAG | R116I | ATT | G182H | CAT | R248W | TGG | S315C | TGT | T381L | TTG |
| G050R | CGG | R116L | CTG | G182L | CTT | R248Y | TAT | S315E | GAG | T381N | AAT |
| G050S | AGT | R116N | AAT | G182M | ATG | E249A | GCT | S315G | GGT | T381P | CCT |
| G050V | GTT | R116P | CCT | G182N | AAT | E249G | GGG | S315H | CAT | T381Q | CAG |
| G050W | TGG | R116Q | CAG | G182P | CCT | E249H | CAT | S315I | ATT | T381R | CGT |
| G050Y | TAT | R116S | TCT | G182Q | CAG | E249I | ATT | S315K | AAG | T381S | AGT |
| Q051A | GCG | R116T | ACT | G182R | CGT | E249K | AAG | S315L | CTG | T381V | GTG |
| Q051C | TGT | R116V | GTG | G182S | AGT | E249L | CTG | S315M | ATG | T381W | TGG |
| Q051D | GAT | R116W | TGG | G182T | ACT | E249M | ATG | S315P | CCT | T381Y | TAT |
| Q051F | TTT | P117D | GAT | G182V | GTT | E249P | CCT | S315R | CGG | V382E | GAG |
| Q051H | CAT | P117E | GAG | G182Y | TAT | E249Q | CAG | S315T | ACT | V382G | GGG |
| Q051I | ATT | P117F | TTT | Y183A | GCT | E249R | CGG | S315V | GTT | V382H | CAT |
| Q051K | AAG | P117G | GGT | Y183C | TGT | E249S | TCT | S315W | TGG | V382I | ATT |
| Q051M | ATG | P117H | CAT | Y183D | GAT | E249T | ACT | S315Y | TAT | V382K | AAG |
| Q051N | AAT | P117I | ATT | Y183E | GAG | E249V | GTG | C316A | GCT | V382L | TTG |
| Q051P | CCT | P117K | AAG | Y183G | GGG | E249W | TGG | C316D | GAT | V382M | ATG |
| Q051R | CGG | P117N | AAT | Y183I | ATT | E249Y | TAT | C316E | GAG | V382N | AAT |
| Q051S | TCT | P117Q | CAG | Y183K | AAG | A250C | TGT | C316G | GGG | V382P | CCT |
| Q051T | ACG | P117R | AGG | Y183L | TTG | A250F | TTT | C316I | ATT | V382Q | CAG |
| Q051W | TGG | P117S | TCG | Y183N | AAT | A250G | GGT | C316K | AAG | V382R | CGG |
| Q051Y | TAT | P117T | ACT | Y183P | CCT | A250H | CAT | C316L | CTG | V382S | TCG |
| G052A | GCT | P117V | GTT | Y183Q | CAG | A250K | AAG | C316M | ATG | V382T | ACT |
| G052C | TGT | P117W | TGG | Y183R | CGT | A250L | CTG | C316P | CCT | V382W | TGG |
| G052E | GAG | P117Y | TAT | Y183S | TCT | A250M | ATG | C316R | AGG | V382Y | TAT |
| G052F | TTT | T118C | TGT | Y183V | GTT | A250N | AAT | C316S | TCT | R383A | GCT |
| G052H | CAT | T118D | GAT | Y183W | TGG | A250P | CCT | C316T | ACT | R383E | GAG |
| G052K | AAG | T118E | GAG | Y184A | GCT | A250Q | CAG | C316V | GTT | R383F | TTT |
| G052L | CTT | T118G | GGG | Y184C | TGT | A250R | AGG | C316W | TGG | R383G | GGG |
| G052M | ATG | T118H | CAT | Y184D | GAT | A250S | TCT | C316Y | TAT | R383H | CAT |
| G052P | CCT | T118K | AAG | Y184E | GAG | A250T | ACG | L317A | GCT | R383I | ATT |
| G052Q | CAG | T118L | CTG | Y184F | TTT | A250V | GTG | L317C | TGT | R383K | AAG |
| G052R | CGG | T118M | ATG | Y184G | GGT | A250W | TGG | L317D | GAT | R383L | CTG |
| G052S | AGT | T118N | AAT | Y184H | CAT | I251C | TGT | L317G | GGG | R383M | ATG |
| G052T | ACT | T118P | CCT | Y184K | AAG | I251D | GAT | L317H | CAT | R383N | AAT |
| G052W | TGG | T118Q | CAG | Y184L | CTT | I251F | TTT | L317I | ATT | R383P | CCT |
| G052Y | TAT | T118R | CGT | Y184M | ATG | I251G | GGG | L317K | AAG | R383S | TCG |
| V053A | GCG | T118V | GTT | Y184P | CCT | I251H | CAT | L317M | ATG | R383T | ACT |
| V053C | TGT | T118W | TGG | Y184R | AGG | I251K | AAG | L317N | AAT | R383V | GTG |
| V053D | GAT | T118Y | TAT | Y184S | TCG | I251L | CTT | L317P | CCT | R383W | TGG |
| V053E | GAG | W119A | GCT | Y184V | GTG | I251M | ATG | L317Q | CAG | G384A | GCT |
| V053G | GGG | W119D | GAT | Y184W | TGG | I251P | CCG | L317R | AGG | G384C | TGT |
| V053H | CAT | W119E | GAG | L185A | GCT | I251Q | CAG | L317S | TCG | G384D | GAT |
| V053L | CTG | W119F | TTT | L185D | GAT | I251S | AGT | L317T | ACT | G384E | GAG |
| V053N | AAT | W119G | GGT | L185E | GAG | I251T | ACT | L317W | TGG | G384F | TTT |
| V053P | CCG | W119I | ATT | L185F | TTT | I251V | GTG | L318C | TGT | G384H | CAT |
| V053Q | CAG | W119K | AAG | L185G | GGG | I251W | TGG | L318D | GAT | G384I | ATT |
| V053R | CGG | W119L | CTG | L185I | ATT | I251Y | TAT | L318F | TTT | G384K | AAG |
| V053S | AGT | W119N | AAT | L185K | AAG | R252A | GCT | L318G | GGG | G384L | CTT |
| V053T | ACT | W119P | CCT | L185N | AAT | R252D | GAT | L318H | CAT | G384M | ATG |
| V053W | TGG | W119Q | CAG | L185P | CCT | R252E | GAG | L318I | ATT | G384P | CCT |
| V053Y | TAT | W119R | CGG | L185R | CGG | R252F | TTT | L318K | AAG | G384Q | CAG |
| T054A | GCG | W119S | TCT | L185S | TCG | R252G | GGT | L318M | ATG | G384R | AGG |
| T054D | GAT | W119V | GTT | L185T | ACT | R252H | CAT | L318N | AAT | G384S | TCG |
| T054E | GAG | W119Y | TAT | L185V | GTG | R252I | ATT | L318P | CCT | G384T | ACT |
| T054F | TTT | A120C | TGT | L185W | TGG | R252K | AAG | L318Q | CAG | K385A | GCT |
| T054G | GGG | A120D | GAT | L185Y | TAT | R252L | CTG | L318R | CGG | K385C | TGT |
| T054H | CAT | A120F | TTT | F186A | GCT | R252N | AAT | L318S | AGT | K385G | GGG |
| T054I | ATT | A120G | GGG | F186D | GAT | R252P | CCT | L318T | ACT | K385H | CAT |
| T054M | ATG | A120H | CAT | F186G | GGT | R252S | TCG | L318W | TGG | K385L | CTT |
| T054N | AAT | A120I | ATT | F186H | CAT | R252T | ACT | L319C | TGT | K385M | ATG |
| T054P | CCG | A120L | CTT | F186I | ATT | R252V | GTG | L319E | GAG | K385N | AAT |
| T054Q | CAG | A120N | AAT | F186K | AAG | R252Y | TAT | L319F | TTT | K385P | CCG |

TABLE 8-continued

PH20 Variants

| mut | cod | mut | cod | mut | cod | mut | cod | mut | cod | mut | cod |
|---|---|---|---|---|---|---|---|---|---|---|---|
| T054R | CGT | A120P | CCT | F186L | CTT | V253A | GCG | L319G | GGG | K385Q | CAG |
| T054S | AGT | A120R | CGT | F186N | AAT | V253D | GAT | L319H | CAT | K385R | CGT |
| T054V | GTT | A120S | TCT | F186P | CCT | V253E | GAG | L319I | ATT | K385S | TCT |
| T054Y | TAT | A120T | ACT | F186Q | CAG | V253G | GCG | L319K | AAG | K385T | ACG |
| I055A | GCT | A120V | GTG | F186R | AGG | V253H | CAT | L319M | ATG | K385V | GTT |
| I055C | TGT | A120W | TGG | F186S | TCT | V253I | ATT | L319P | CCT | K385W | TGG |
| I055D | GAT | A120Y | TAT | F186V | GTT | V253L | CTG | L319Q | CAG | K385Y | TAT |
| I055F | TTT | R121A | GCT | F186W | TGG | V253M | ATG | L319R | AGG | P386A | GCG |
| I055G | GGG | R121C | TGT | F186Y | TAT | V253N | AAT | L319S | TCG | P386C | TGT |
| I055H | CAT | R121D | GAT | P187A | GCT | V253P | CCT | L319V | GTT | P386F | TTT |
| I055L | CTG | R121E | GAG | P187F | TTT | V253Q | CAG | L319W | TGG | P386G | GGG |
| I055N | AAT | R121F | TTT | P187G | GGG | V253R | CGG | L319Y | TAT | P386H | CAT |
| I055P | CCT | R121G | GGT | P187H | CAT | V253S | TCG | D320C | TGT | P386I | ATT |
| I055Q | CAG | R121H | CAT | P187I | ATT | V253T | ACG | D320E | GAG | P386L | CTT |
| I055R | CGT | R121K | AAG | P187L | CTT | V253W | TGG | D320F | TTT | P386M | ATG |
| I055S | TCG | R121L | CTG | P187M | ATG | S254C | TGT | D320G | GGG | P386N | AAT |
| I055T | ACT | R121M | ATG | P187N | AAT | S254D | GAT | D320H | CAT | P386Q | CAG |
| I055V | GTT | R121P | CCT | P187Q | CAG | S254E | GAG | D320I | ATT | P386R | CGT |
| I055Y | TAT | R121S | TCG | P187R | AGG | S254G | GGG | D320K | AAG | P386S | AGT |
| F056A | GCG | R121T | ACT | P187S | TCG | S254I | ATT | D320L | TTG | P386T | ACG |
| F056C | TGT | R121V | GTT | P187T | ACT | S254K | AAG | D320M | ATG | P386V | GTT |
| F056E | GAG | R121W | TGG | P187V | GTT | S254L | TTG | D320N | AAT | P386Y | TAT |
| F056G | GGG | R121Y | TAT | P187W | TGG | S254N | AAT | D320P | CCT | T387C | TGT |
| F056H | CAT | N122A | GCT | P187Y | TAT | S254P | CCT | D320R | AGG | T387E | GAG |
| F056I | ATT | N122C | TGT | D188A | GCT | S254Q | CAG | D320S | AGT | T387F | TTT |
| F056K | AAG | N122E | GAG | D188C | TGT | S254R | CGG | D320V | GTG | T387G | GGG |
| F056L | TTG | N122F | TTT | D188F | TTT | S254T | ACT | D320W | TGG | T387H | CAT |
| F056N | AAT | N122I | ATT | D188G | GGG | S254V | GTG | D320Y | TAT | T387I | ATT |
| F056P | CCG | N122K | AAG | D188H | CAT | S254W | TGG | N321A | GCT | T387K | AAG |
| F056R | CGT | N122L | CTG | D188L | CTT | S254Y | TAT | N321D | GAT | T387L | CTG |
| F056S | TCT | N122M | ATG | D188M | ATG | K255A | GCG | N321E | GAG | T387M | ATG |
| F056T | ACT | N122P | CCT | D188N | AAT | K255C | TGT | N321G | GGT | T387N | AAT |
| F056V | GTT | N122Q | CAG | D188P | CCT | K255D | GAT | N321H | CAT | T387Q | CAG |
| F056W | TGG | N122R | CGG | D188Q | CAG | K255G | GGT | N321I | ATT | T387S | TCG |
| Y057A | GCT | N122S | TCT | D188R | AGG | K255H | CAT | N321K | AAG | T387V | GTT |
| Y057D | GAT | N122T | ACT | D188S | AGT | K255L | TTG | N321L | CTG | T387W | TGG |
| Y057E | GAG | N122V | GTT | D188T | ACT | K255N | AAT | N321M | ATG | T387Y | TAT |
| Y057F | TTT | N122W | TGG | D188V | GTG | K255P | CCG | N321P | CCT | L388A | GCG |
| Y057G | GGG | W123A | GCT | D188W | TGG | K255Q | CAG | N321R | CGG | L388C | TGT |
| Y057I | ATT | W123C | TGT | C189A | GCT | K255R | CGG | N321S | TCT | L388F | TTT |
| Y057L | TTG | W123D | GAT | C189E | GAG | K255S | TCG | N321T | ACT | L388G | GGG |
| Y057M | ATG | W123E | GAG | C189G | GGT | K255T | ACT | N321V | GTG | L388H | CAT |
| Y057P | CCG | W123G | GGG | C189H | CAT | K255V | GTT | N321Y | TAT | L388I | ATT |
| Y057Q | CAG | W123H | CAT | C189K | AAG | K255W | TGG | Y322C | TGT | L388M | ATG |
| Y057R | CGG | W123L | CTT | C189L | TTG | K255Y | TAT | Y322D | GAT | L388P | CCT |
| Y057S | AGT | W123M | ATG | C189M | ATG | I256A | GCT | Y322E | GAG | L388Q | CAG |
| Y057T | ACG | W123P | CCT | C189N | ACT | I256C | TGT | Y322F | TTT | L388R | CGT |
| Y057V | GTG | W123Q | CAG | C189P | CCT | I256D | GAT | Y322G | GGT | L388S | TCG |
| Y057W | TGG | W123R | AGG | C189R | AGG | I256E | GAG | Y322H | CAT | L388T | ACG |
| V058A | GCT | W123S | AGT | C189S | TCG | I256G | GGG | Y322I | ATT | L388V | GTT |
| V058C | TGT | W123T | ACT | C189T | ACT | I256H | CAT | Y322L | CTG | L388W | TGG |
| V058D | GAT | W123V | GTT | C189V | GTG | I256L | CTT | Y322N | AAT | L388Y | TAT |
| V058G | GGT | W123Y | TAT | C189W | TGG | I256M | ATG | Y322P | CCT | E389A | GCT |
| V058H | CAT | K124A | GCT | C189Y | TAT | I256N | AAT | Y322R | CGT | E389F | TTT |
| V058I | ATT | K124C | TGT | Y190C | TGT | I256P | CCG | Y322S | TCT | E389G | GGT |
| V058K | AAG | K124D | GAT | Y190E | GAG | I256Q | CAG | Y322T | ACT | E389H | CAT |
| V058L | CTT | K124E | GAG | Y190F | TTT | I256R | AGG | Y322V | GTG | E389I | ATT |
| V058N | AAT | K124F | TTT | Y190G | GGG | I256T | ACG | Y322W | TGG | E389K | AAG |
| V058P | CCT | K124G | GGG | Y190H | CAT | I256V | GTT | M323A | GCT | E389L | CTG |
| V058Q | CAG | K124H | CAT | Y190K | AAG | I256W | TGG | M323C | TGT | E389M | ATG |
| V058R | CGG | K124I | ATT | Y190L | CTT | P257A | GCG | M323E | GAG | E389P | CCT |
| V058S | TCG | K124L | CTT | Y190N | AAT | P257C | TGT | M323F | TTT | E389Q | CAG |
| V058W | TGG | K124N | AAT | Y190P | CCT | P257D | GAT | M323G | GGG | E389R | CGG |
| V058Y | TAT | K124P | CCT | Y190Q | CAG | P257G | GGG | M323H | CAT | E389S | TCG |
| D059A | GCT | K124R | CGG | Y190R | CGT | P257I | ATT | M323I | ATT | E389T | ACT |
| D059E | GAG | K124S | TCT | Y190S | TCT | P257K | AAG | M323K | AAG | E389V | GTT |
| D059G | GGG | K124T | ACT | Y190T | ACT | P257L | CTT | M323L | TTG | E389Y | TAT |
| D059H | CAT | K124V | GTG | Y190V | GTG | P257M | ATG | M323N | AAT | D390A | GCG |
| D059I | ATT | K124W | TGG | Y190W | TGG | P257N | AAT | M323P | CCT | D390C | TGT |
| D059L | CTT | P125A | GCT | N191A | GCT | P257Q | CAG | M323R | CGG | D390E | GAG |
| D059M | ATG | P125C | TGT | N191E | GAG | P257R | CGT | M323S | AGT | D390F | TTT |
| D059N | AAT | P125D | GAT | N191F | TTT | P257S | TCG | M323T | ACT | D390G | GGG |
| D059P | CCT | P125G | GGG | N191G | GGG | P257T | ACG | M323V | GTT | D390H | CAT |
| D059Q | CAG | P125H | CAT | N191K | AAG | P257V | GTG | E324A | GCT | D390L | CTT |
| D059R | CGT | P125I | ATT | N191L | TTG | P257W | TGG | E324C | TGT | D390N | AAT |
| D059T | ACG | P125L | CTT | N191M | ATG | D258A | GCG | E324D | GAT | D390P | CCG |

TABLE 8-continued

PH20 Variants

| mut | cod | mut | cod | mut | cod | mut | cod | mut | cod | mut | cod |
|---|---|---|---|---|---|---|---|---|---|---|---|
| D059V | GTG | P125N | AAT | N191P | CCT | D258E | GAG | E324F | TTT | D390R | CGG |
| D059W | TGG | P125Q | CAG | N191Q | CAG | D258G | GGG | E324G | GGG | D390S | AGT |
| D059Y | TAT | P125R | CGT | N191R | CGG | D258H | CAT | E324H | CAT | D390T | ACT |
| R060A | GCG | P125S | TCG | N191S | TCG | D258I | ATT | E324L | TTG | D390V | GTG |
| R060D | GAT | P125T | ACT | N191T | ACT | D258L | CTT | E324M | ATG | D390W | TGG |
| R060F | TTT | P125V | GTG | N191V | GTT | D258N | AAT | E324N | AAT | D390Y | TAT |
| R060G | GGT | P125W | TGG | N191W | TGG | D258P | CCG | E324P | CCT | L391A | GCT |
| R060H | CAT | P125Y | TAT | N191Y | TAT | D258Q | CAG | E324R | CGG | L391C | TGT |
| R060I | ATT | K126A | GCT | H192C | TGT | D258R | CGT | E324S | AGT | L391D | GAT |
| R060K | AAG | K126D | GAT | H192F | TTT | D258S | AGT | E324V | GTG | L391G | GGG |
| R060L | CTT | K126E | GAG | H192G | GGT | D258T | ACG | E324W | TGG | L391H | CAT |
| R060N | AAT | K126F | TTT | H192K | AAG | D258V | GTG | E324Y | TAT | L391K | AAG |
| R060P | CCG | K126G | GGT | H192L | CTT | D258W | TGG | T325A | GCG | L391N | AAT |
| R060Q | CAG | K126H | CAT | H192M | ATG | D258Y | TAT | T325C | TGT | L391P | CCT |
| R060S | TCG | K126I | ATT | H192N | AAT | A259E | GAG | T325D | GAT | L391Q | CAG |
| R060T | ACG | K126L | CTG | H192P | CCT | A259G | GGG | T325E | GAG | L391R | CGG |
| R060V | GTT | K126M | ATG | H192Q | CAG | A259I | ATT | T325G | GGT | L391S | TCT |
| R060Y | TAT | K126N | AAT | H192R | CGT | A259K | AAG | T325H | CAT | L391T | ACT |
| L061A | GCT | K126P | CCT | H192S | TCG | A259L | TTG | T325I | ATT | L391V | GTG |
| L061E | GAG | K126Q | CAG | H192T | ACT | A259M | ATG | T325K | AAG | L391W | TGG |
| L061F | TTT | K126R | AGG | H192V | GTT | A259N | AAT | T325M | ATG | L391Y | TAT |
| L061G | GGG | K126S | TCT | H192W | TGG | A259P | CCT | T325N | AAT | E392A | GCT |
| L061H | CAT | K126T | ACT | H192Y | TAT | A259Q | CAG | T325Q | CAG | E392C | TGT |
| L061I | ATT | K126V | GTG | H193A | GCT | A259R | CGT | T325R | CGG | E392F | TTT |
| L061M | ATG | K126W | TGG | H193C | TGT | A259S | AGT | T325S | TCG | E392G | GGG |
| L061N | AAT | K126Y | TAT | H193D | GAT | A259T | ACT | T325V | GTG | E392K | AAG |
| L061P | CCT | D127A | GCT | H193F | TTT | A259V | GTT | T325W | TGG | E392L | CTG |
| L061Q | CAG | D127E | GAG | H193G | GGG | A259W | TGG | I326A | GCT | E392M | ATG |
| L061R | AGG | D127F | TTT | H193K | AAG | A259Y | TAT | I326C | TGT | E392P | CCT |
| L061T | ACT | D127G | GGT | H193L | TTG | K260A | GCG | I326D | GAT | E392Q | CAG |
| L061V | GTT | D127H | CAT | H193M | ATG | K260C | TGT | I326E | GAG | E392R | AGG |
| L061W | TGG | D127K | AAG | H193P | CCG | K260D | GAT | I326G | GGG | E392S | AGT |
| L061Y | TAT | D127L | CTG | H193Q | CAG | K260E | GAG | I326H | CAT | E392T | ACT |
| G062A | GCG | D127M | ATG | H193R | AGG | K260G | GGG | I326K | AAG | E392V | GTT |
| G062C | TGT | D127N | AAT | H193S | TCT | K260H | CAT | I326L | CTT | E392W | TGG |
| G062D | GAT | D127Q | CAG | H193T | ACG | K260L | TTG | I326N | AAT | E392Y | TAT |
| G062F | TTT | D127R | CGT | H193V | GTG | K260M | ATG | I326P | CCT | Q393A | GCG |
| G062I | ATT | D127S | AGT | H193Y | TAT | K260P | CCG | I326R | CGG | Q393C | TGT |
| G062K | AAG | D127T | ACT | Y194A | GCT | K260Q | CAG | I326S | TCT | Q393D | GAT |
| G062L | CTT | D127V | GTT | Y194C | TGT | K260R | CGG | I326V | GTG | Q393F | TTT |
| G062M | ATG | D127W | TGG | Y194E | GAG | K260S | TCT | I326W | TGG | Q393G | GGT |
| G062P | CCT | V128A | GCT | Y194F | TTT | K260V | GTT | I326Y | TAT | Q393H | CAT |
| G062Q | CAG | V128C | TGT | Y194G | GGG | K260W | TGG | L327A | GCT | Q393I | ATT |
| G062R | CGT | V128E | GAG | Y194I | ATT | K260Y | TAT | L327D | GAT | Q393K | AAG |
| G062S | AGT | V128F | TTT | Y194L | TTG | S261A | GCG | L327E | GAG | Q393L | TTG |
| G062T | ACT | V128G | GGG | Y194N | AAT | S261E | GAG | L327F | TTT | Q393M | ATG |
| G062V | GTG | V128H | CAT | Y194P | CCT | S261F | TTT | L327G | GGG | Q393N | AAT |
| G062Y | TAT | V128I | ATT | Y194Q | CAG | S261G | GGG | L327H | CAT | Q393P | CCG |
| Y063A | GCG | V128K | AAG | Y194R | AGG | S261I | ATT | L327M | ATG | Q393R | CGT |
| Y063C | TGT | V128L | CTG | Y194S | TCG | S261K | AAG | L327N | AAT | Q393S | TCG |
| Y063G | GGT | V128P | CCT | Y194T | ACG | S261L | CTT | L327Q | CAG | Q393T | ACG |
| Y063H | CAT | V128Q | CAG | Y194V | GTG | S261M | ATG | L327R | CGG | F394A | GCG |
| Y063I | ATT | V128R | AGG | Y194W | TGG | S261N | AAT | L327S | AGT | F394D | GAT |
| Y063K | AAG | V128S | TCG | K195A | GCG | S261P | CCT | L327T | ACT | F394E | GAG |
| Y063L | CTG | V128W | TGG | K195E | GAG | S261Q | CAG | L327V | GTG | F394G | GGG |
| Y063M | ATG | V128Y | TAT | K195F | TTT | S261R | CGT | L327W | TGG | F394I | ATT |
| Y063N | AAT | Y129A | GCT | K195G | GGT | S261T | ACT | L327Y | TAT | F394K | AAG |
| Y063P | CCT | Y129C | TGT | K195H | CAT | S261V | GTT | N328A | GCT | F394L | CTG |
| Y063R | AGG | Y129D | GAT | K195I | ATT | S261W | TGG | N328C | TGT | F394N | AAT |
| Y063S | TCT | Y129E | GAG | K195L | TTG | P262A | GCG | N328D | GAT | F394P | CCG |
| Y063T | ACG | Y129G | GGG | K195N | AAT | P262D | GAT | N328G | GGT | F394Q | CAG |
| Y063V | GTG | Y129H | CAT | K195Q | CAG | P262E | GAG | N328H | CAT | F394R | CGT |
| Y063W | TGG | Y129L | TTG | K195R | CGT | P262F | TTT | N328I | ATT | F394S | TCG |
| Y064A | GCT | Y129M | ATG | K195S | TCT | P262G | GGG | N328K | AAG | F394T | ACT |
| Y064C | TGT | Y129P | CCT | K195T | ACT | P262H | CAT | N328L | CTT | F394V | GTT |
| Y064D | GAT | Y129Q | CAG | K195V | GTG | P262I | ATT | N328Q | CAG | F394W | TGG |
| Y064E | GAG | Y129R | CGG | K195W | TGG | P262K | AAG | N328R | AGG | S395A | GCG |
| Y064F | TTT | Y129S | AGT | K195Y | TAT | P262Q | CAG | N328S | AGT | S395C | TGT |
| Y064G | GGT | Y129T | ACT | K196A | GCT | P262R | CGT | N328T | ACT | S395D | GAT |
| Y064H | CAT | Y129V | GTT | K196C | TGT | P262S | TCT | N328V | GTG | S395E | GAG |
| Y064I | ATT | Y129W | TGG | K196D | GAT | P262T | ACT | N328W | TGG | S395G | GGG |
| Y064K | AAG | K130C | TGT | K196E | GAG | P262V | GTG | N328Y | TAT | S395H | CAT |
| Y064L | CTT | K130D | GAT | K196G | GGG | P262W | TGG | P329C | TGT | S395K | AAG |
| Y064P | CCT | K130E | GAG | K196I | ATT | P262Y | TAT | P329F | TTT | S395L | CTT |
| Y064Q | CAG | K130G | GGG | K196L | TTG | L263A | GCT | P329G | GGT | S395M | ATG |
| Y064R | CGG | K130H | CAT | K196N | AAT | L263E | GAG | P329H | CAT | S395P | CCT |

TABLE 8-continued

PH20 Variants

| mut | cod | mut | cod | mut | cod | mut | cod | mut | cod | mut | cod |
|---|---|---|---|---|---|---|---|---|---|---|---|
| Y064S | AGT | K130I | ATT | K196P | CCG | L263F | TTT | P329I | ATT | S395R | CGG |
| Y064T | ACT | K130L | TTG | K196R | CGT | L263G | GGG | P329K | AAG | S395T | ACG |
| Y064V | GTT | K130N | AAT | K196S | TCG | L263H | CAT | P329L | CTG | S395V | GTT |
| Y064W | TGG | K130Q | CAG | K196T | ACT | L263K | AAG | P329N | AAT | S395W | TGG |
| P065A | GCT | K130R | AGG | K196V | GTG | L263M | ATG | P329Q | CAG | S395Y | TAT |
| P065C | TGT | K130S | TCT | K196W | TGG | L263N | AAT | P329R | CGT | E396A | GCG |
| P065D | GAT | K130T | ACT | K196Y | TAT | L263P | CCG | P329S | AGT | E396C | TGT |
| P065F | TTT | K130V | GTG | P197A | GCT | L263Q | CAG | P329T | ACT | E396D | GAT |
| P065G | GGG | K130W | TGG | P197C | TGT | L263R | CGG | P329V | GTT | E396F | TTT |
| P065H | CAT | K130Y | TAT | P197D | GAT | L263S | AGT | P329W | TGG | E396G | GGG |
| P065I | ATT | N131C | TGT | P197E | GAG | L263T | ACT | P329Y | TAT | E396H | CAT |
| P065K | AAG | N131E | GAG | P197F | TTT | L263V | GTT | Y330A | GCT | E396I | ATT |
| P065N | AAT | N131F | TTT | P197G | GGT | L263W | TGG | Y330C | TGT | E396L | CTT |
| P065R | CGG | N131G | GGG | P197H | CAT | P264A | GCG | Y330D | GAT | E396P | CCG |
| P065S | TCG | N131H | CAT | P197K | AAG | P264D | GAT | Y330E | GAG | E396Q | CAG |
| P065T | ACG | N131I | ATT | P197L | TTG | P264E | GAG | Y330F | TTT | E396R | AGG |
| P065V | GTT | N131L | CTT | P197M | ATG | P264F | TTT | Y330G | GGT | E396S | TCT |
| P065W | TGG | N131M | ATG | P197Q | CAG | P264G | GGT | Y330I | ATT | E396T | ACT |
| P065Y | TAT | N131P | CCT | P197R | CGT | P264H | CAT | Y330L | CTG | E396V | GTG |
| Y066A | GCG | N131Q | CAG | P197S | AGT | P264L | CTT | Y330M | ATG | E396Y | TAT |
| Y066C | TGT | N131R | CGG | P197T | ACT | P264M | ATG | Y330N | AAT | K397A | GCT |
| Y066D | GAT | N131S | AGT | P197W | TGG | P264N | AAT | Y330P | CCT | K397C | TGT |
| Y066E | GAG | N131T | ACT | G198A | GCT | P264R | CGG | Y330R | AGG | K397E | GAG |
| Y066G | GGT | N131V | GTG | G198C | TGT | P264S | AGT | Y330S | AGT | K397F | TTT |
| Y066H | CAT | N131Y | TAT | G198D | GAT | P264T | ACT | Y330V | GTT | K397G | GGT |
| Y066I | ATT | R132A | GCT | G198E | GAG | P264V | GTT | I331V | GTG | K397I | ATT |
| Y066K | AAG | R132C | TGT | G198H | CAT | P264W | TGG | Y330W | TGG | K397L | TTG |
| Y066L | CTG | R132E | GAG | G198L | CTG | P264Y | TAT | I331A | GCT | K397M | ATG |
| Y066N | AAT | R132F | TTT | G198N | AAT | V265A | GCG | I331C | TGT | K397N | AAT |
| Y066P | CCT | R132H | CAT | G198P | CCG | V265C | TGT | I331D | GAT | K397P | CCG |
| Y066R | CGG | R132I | ATT | G198Q | CAG | V265D | GAT | I331E | GAG | K397Q | CAG |
| K397T | ACT | R132K | AAG | G198R | AGG | V265E | GAG | I331F | TTT | K397R | AGG |
| K397V | GTT | R132L | TTG | G198S | TCT | V265F | TTT | I331H | CAT | K397S | TCG |
| F398A | GCT | L406P | CCT | K415G | GGT | C423T | ACT | A432L | TTG | E441D | GAT |
| F398C | TGT | L406Q | CAG | K415L | CTG | C423V | GTG | A432M | ATG | E441F | TTT |
| F398E | GAG | L406R | CGG | K415M | ATG | C423W | TGG | A432N | AAT | E441G | GGG |
| F398G | GGT | L406S | AGT | K415P | CCG | I424A | GCT | A432P | CCT | E441H | CAT |
| F398H | CAT | L406T | ACG | K415Q | CAG | I424C | TGT | A432R | AGG | E441K | AAG |
| F398I | ATT | L406V | GTT | K415R | CGG | I424E | GAG | A432S | TCT | E441L | CTT |
| F398L | CTT | L406Y | TAT | K415S | TCT | I424G | GGG | A432V | GTG | E441N | AAT |
| F398N | AAT | S407A | GCG | K415T | ACT | I424H | CAT | A432Y | TAT | E441Q | CAG |
| F398P | CCT | S407D | GAT | K415V | GTG | I424K | AAG | F433A | GCT | E441R | CGG |
| F398R | AGG | S407E | GAG | K415W | TGG | I424L | CTT | F433C | TGT | E441S | AGT |
| F398S | TCT | S407F | TTT | K415Y | TAT | I424N | AAT | F433D | GAT | E441T | ACT |
| F398T | ACT | S407G | GGT | D416C | TGT | I424Q | CAG | F433E | GAG | E441V | GTG |
| F398V | GTT | S407H | CAT | D416F | TTT | I424R | CGG | F433G | GGG | E441Y | TAT |
| F398W | TGG | S407L | CTG | D416G | GGT | I424S | TCG | F433H | CAT | E442C | TGT |
| F398Y | TAT | S407M | ATG | D416H | CAT | I424T | ACT | F433I | ATT | E442G | GGG |
| Y399A | GCG | S407N | AAT | D416I | ATT | I424V | GTT | F433K | AAG | E442H | CAT |
| Y399C | TGT | S407P | CCT | D416K | AAG | I424W | TGG | F433L | TTG | E442K | AAG |
| Y399D | GAT | S407Q | CAG | D416L | CTT | I424Y | TAT | F433P | CCT | E442L | CTT |
| Y399E | GAG | S407R | CGG | D416N | AAT | A425C | TGT | F433R | CGG | E442M | ATG |
| Y399G | GGG | S407T | ACG | D416Q | CAG | A425D | GAT | F433S | AGT | E442N | AAT |
| Y399K | AAG | S407V | GTG | D416R | CGG | A425E | GAG | F433T | ACT | E442P | CCT |
| Y399M | ATG | S407W | TGG | D416S | TCT | A425G | GGT | F433V | GTG | E442Q | CAG |
| Y399N | AAT | C408A | GCG | D416T | ACG | A425I | ATT | F433W | TGG | E442R | CGG |
| Y399P | CCT | C408E | GAG | D416V | GTG | A425K | AAG | L434F | TTT | E442S | AGT |
| Y399Q | CAG | C408F | TTT | D416W | TGG | A425L | TTG | L434G | GGT | E442T | ACT |
| Y399R | CGG | C408G | GGG | D416Y | TAT | A425M | ATG | L434H | CAT | E442V | GTG |
| Y399S | TCG | C408I | ATT | T417A | GCT | A425N | AAT | L434I | ATT | E442W | TGG |
| Y399T | ACG | C408K | AAG | T417D | GAT | A425P | CCT | L434K | AAG | E442Y | TAT |
| Y399V | GTT | C408L | CTT | T417E | GAG | A425R | AGG | L434M | ATG | P443A | GCT |
| Y399W | TGG | C408N | AAT | T417F | TTT | A425S | AGT | L434N | AAT | P443D | GAT |
| C400A | GCG | C408P | CCT | T417G | GGG | A425V | GTG | L434P | CCT | P443E | GAG |
| C400D | GAT | C408R | CGT | T417H | CAT | A425W | TGG | L434Q | CAG | P443F | TTT |
| C400E | GAG | C408S | TCG | T417I | ATT | A425Y | TAT | L434R | CGG | P443G | GGG |
| C400F | TTT | C408T | ACT | T417K | AAG | D426A | GCT | L434S | AGT | P443H | CAT |
| C400G | GGG | C408V | GTT | T417L | TTG | D426C | TGT | L434T | ACT | P443I | ATT |
| C400I | ATT | C408W | TGG | T417M | ATG | D426E | GAG | L434V | GTT | P443L | CTT |
| C400L | CTG | C408Y | TAT | T417P | CCT | D426F | TTT | L434W | TGG | P443M | ATG |
| C400M | ATG | K409A | GCG | T417Q | CAG | D426G | GGG | L434Y | TAT | P443N | AAT |
| C400P | CCG | K409C | TGT | T417R | CGT | D426I | ATT | K435A | GCT | P443Q | CAG |
| C400Q | CAG | K409D | GAT | T417S | TCG | D426K | AAG | K435C | TGT | P443R | AGG |
| C400R | CGG | K409E | GAG | T417W | TGG | D426L | CTG | K435E | GAG | P443S | TCT |
| C400S | AGT | K409G | GGT | D418A | GCT | D426M | ATG | K435F | TTT | P443T | ACT |
| C400T | ACG | K409H | CAT | D418C | TGT | D426N | AAT | K435G | GGT | P443W | TGG |

TABLE 8-continued

PH20 Variants

| mut | cod | mut | cod | mut | cod | mut | cod | mut | cod | mut | cod |
|---|---|---|---|---|---|---|---|---|---|---|---|
| C400V | GTG | K409I | ATT | D418E | GAG | D426P | CCT | K435H | CAT | Q444C | TGT |
| C400Y | TAT | K409L | CTG | D418F | TTT | D426Q | CAG | K435I | ATT | Q444D | GAT |
| S401A | GCT | K409P | CCG | D418G | GGT | D426R | CGT | K435L | CTG | Q444E | GAG |
| S401C | TGT | K409Q | CAG | D418I | ATT | D426S | TCG | K435P | CCT | Q444F | TTT |
| S401D | GAT | K409R | AGG | D418L | TTG | D426Y | TAT | K435R | AGG | Q444G | GGG |
| S401E | GAG | K409S | TCG | D418M | ATG | G427A | GCT | K435S | TCT | Q444H | CAT |
| S401F | TTT | K409T | ACG | D418N | AAT | G427C | TGT | K435T | ACT | Q444I | ATT |
| S401G | GGG | K409V | GTG | D418P | CCT | G427F | TTT | K435V | GTT | Q444K | AAG |
| S401H | CAT | K409W | TGG | D418Q | CAG | G427H | CAT | K435W | TGG | Q444L | CTG |
| S401K | AAG | A412Y | TAT | D418R | CGG | G427I | ATT | K435Y | TAT | Q444M | ATG |
| S401L | CTT | E410D | GAT | D418S | TCG | G427K | AAG | P436C | TGT | Q444N | AAT |
| S401N | AAT | E410G | GGG | D418V | GTG | G427L | CTG | P436D | GAT | Q444R | CGG |
| S401Q | CAG | E410I | ATT | D418Y | TAT | G427P | CCT | P436E | GAG | Q444V | GTT |
| S401R | CGT | E410K | AAG | A419D | GAT | G427Q | CAG | P436G | GGG | Q444W | TGG |
| S401T | ACT | E410L | CTT | A419E | GAG | G427R | CGT | P436H | CAT | Q444Y | TAT |
| S401W | TGG | E410M | ATG | A419F | TTT | G427S | AGT | P436I | ATT | I445A | GCT |
| S401Y | TAT | E410N | AAT | A419G | GGG | G427T | ACT | P436K | AAG | I445C | TGT |
| C402A | GCT | E410P | CCG | A419H | CAT | G427V | GTG | P436L | CTG | I445D | GAT |
| C402D | GAT | E410Q | CAG | A419I | ATT | G427W | TGG | P436M | ATG | I445G | GGG |
| C402E | GAG | E410R | CGT | A419K | AAG | G427Y | TAT | P436Q | CAG | I445H | CAT |
| C402F | TTT | E410S | TCG | A419L | CTT | V428A | GCT | P436R | CGG | I445K | AAG |
| C402G | GGG | E410T | ACG | A419N | AAT | V428C | TGT | P436S | TCT | I445L | CTT |
| C402L | TTG | E410V | GTG | A419P | CCT | V428D | GAT | P436T | ACT | I445M | ATG |
| C402M | ATG | E410W | TGG | A419R | CGG | V428E | GAG | P436W | TGG | I445N | AAT |
| C402P | CCT | E410Y | TAT | A419S | TCT | V428F | TTT | P436Y | TAT | I445P | CCT |
| C402Q | CAG | K411A | GCT | A419T | ACT | V428G | GGT | P437A | GCT | I445Q | CAG |
| C402R | CGG | K411D | GAT | A419W | TGG | V428H | CAT | P437D | GAT | I445R | AGG |
| C402S | TCT | K411E | GAG | A419Y | TAT | V428L | CTT | P437F | TTT | I445S | AGT |
| C402T | ACG | K411F | TTT | V420A | GCT | V428M | ATG | P437G | GGT | I445T | ACT |
| C402V | GTT | K411G | GGG | V420D | GAT | V428N | AAT | P437H | CAT | I445V | GTG |
| C402W | TGG | K411H | CAT | V420F | TTT | V428P | CCT | P437I | ATT | I445W | TGG |
| C402Y | TAT | K411I | ATT | V420G | GGT | V428R | CGG | P437K | AAG | I445Y | TAT |
| Y403A | GCT | K411L | CTG | V420H | CAT | V428S | TCG | P437L | CTG | F446A | GCT |
| Y403C | TGT | K411N | AAT | V420I | ATT | V428T | ACT | P437M | ATG | F446C | TGT |
| Y403E | GAG | K411P | CCT | V420K | AAG | V428Y | TAT | P437Q | CAG | F446D | GAT |
| Y403F | TTT | K411R | AGG | V420L | CTT | C429A | GCT | P437R | CGT | F446E | GAG |
| Y403G | GGT | K411S | TCG | V420N | AAT | C429D | GAT | P437S | TCT | F446G | GGG |
| Y403H | CAT | K411T | ACT | V420P | CCT | C429G | GGT | P437T | ACT | F446H | CAT |
| Y403K | AAG | K411V | GTT | V420R | AGG | C429I | ATT | P437W | TGG | F446I | ATT |
| Y403L | TTG | K411W | TGG | V420S | TCT | C429K | AAG | P437Y | TAT | F446K | AAG |
| Y403M | ATG | A412D | GAT | V420T | ACT | C429L | TTG | M438A | GCT | F446L | TTG |
| Y403N | AAT | A412E | GAG | V420W | TGG | C429M | ATG | M438C | TGT | F446M | ATG |
| Y403P | CCG | A412G | GGG | V420Y | TAT | C429N | AAT | M438D | GAT | F446Q | CAG |
| Y403Q | CAG | A412H | CAT | D421A | GCT | C429P | CCT | M438E | GAG | F446R | CGG |
| Y403R | CGG | A412I | ATT | D421E | GAG | C429R | CGG | M438G | GGG | F446T | ACT |
| Y403S | TCT | A412L | CTG | D421G | GGT | C429S | TCG | M438H | CAT | F446V | GTT |
| Y403T | ACG | A412N | AAT | D421H | CAT | C429T | ACT | M438N | AAT | F446W | TGG |
| S404A | GCT | A412P | CCT | D421I | ATT | C429V | GTT | M438P | CCT | Y447D | GAT |
| S404C | TGT | A412Q | CAG | D421K | AAG | C429W | TGG | M438Q | CAG | Y447E | GAG |
| S404D | GAT | A412R | CGG | D421L | TTG | C429Y | TAT | M438R | AGG | Y447F | TTT |
| S404F | TTT | A412S | AGT | D421M | ATG | I430A | GCT | M438S | TCG | Y447G | GGT |
| S404G | GGT | A412V | GTT | D421N | AAT | I430D | GAT | M438T | ACT | Y447I | ATT |
| S404H | CAT | A412W | TGG | D421Q | CAG | I430E | GAG | M438V | GTG | Y447K | AAG |
| S404L | CTT | D413A | GCG | D421R | CGG | I430G | GGT | M438W | TGG | Y447L | CTT |
| S404M | ATG | D413E | GAG | D421S | TCG | I430H | CAT | M438Y | TAT | Y447M | ATG |
| S404N | AAT | D413F | TTT | D421T | ACT | I430K | AAG | E439A | GCT | Y447N | AAT |
| S404P | CCT | D413G | GGT | D421W | TGG | I430L | TTG | E439C | TGT | Y447P | CCT |
| S404R | AGG | D413H | CAT | D421Y | TAT | I430M | ATG | E439F | TTT | Y447Q | CAG |
| S404T | ACG | D413I | ATT | V422A | GCT | I430N | AAT | E439G | GGG | Y447R | AGG |
| S404V | GTG | D413K | AAG | V422C | TGT | I430P | CCT | E439H | CAT | Y447T | ACT |
| S404W | TGG | D413L | CTG | V422D | GAT | I430R | AGG | E439K | AAG | Y447V | GTT |
| S404Y | TAT | D413N | AAT | V422E | GAG | I430S | TCT | E439L | CTT | Y447W | TGG |
| T405A | GCG | D413P | CCG | V422G | GGG | I430T | ACT | E439N | AAT | | |
| T405C | TGT | D413Q | CAG | V422H | CAT | I430V | GTT | E439P | CCT | | |
| T405F | TTT | D413R | CGT | V422I | ATT | I430W | TGG | E439Q | CAG | | |
| T405G | GGG | D413S | TCG | V422L | CTG | D431A | GCT | E439R | CGG | | |
| T405I | ATT | D413T | ACT | V422M | ATG | D431E | GAG | E439S | TCG | | |
| T405K | AAG | D413W | TGG | V422N | AAT | D431G | GGT | E439T | ACT | | |
| T405L | TTG | V414A | GCG | V422P | CCT | D431H | CAT | E439V | GTT | | |
| T405M | ATG | V414D | GAT | V422Q | CAG | D431I | ATT | E439W | TGG | | |
| T405P | CCG | V414E | GAG | V422R | CGT | D431K | AAG | T440A | GCT | | |
| T405Q | CAG | V414F | TTT | V422S | TCG | D431L | CTT | T440D | GAT | | |
| T405R | CGT | V414G | GGT | V422T | ACT | D431N | AAT | T440E | GAG | | |
| T405S | TCT | V414H | CAT | V422W | TGG | D431P | CCT | T440F | TTT | | |
| T405V | GTG | V414I | ATT | V422Y | TAT | D431Q | CAG | T440G | GGG | | |
| T405W | TGG | V414K | AAG | C423A | GCT | D431R | CGT | T440H | CAT | | |

TABLE 8-continued

PH20 Variants

| mut | cod | mut | cod | mut | cod | mut | cod | mut | cod | mut | cod |
|---|---|---|---|---|---|---|---|---|---|---|---|
| T405Y | TAT | V414L | TTG | C423D | GAT | D431S | TCT | T440I | ATT | | |
| L406A | GCT | V414M | ATG | C423E | GAG | D431V | GTT | T440L | CTT | | |
| L406C | TGT | V414Q | CAG | C423F | TTT | D431W | TGG | T440M | ATG | | |
| L406D | GAT | V414R | AGG | C423G | GGG | D431Y | TAT | T440P | CCT | | |
| L406E | GAG | V414S | TCG | C423H | CAT | A432C | TGT | T440Q | CAG | | |
| L406F | TTT | V414T | ACT | C423L | CTG | A432E | GAG | T440R | AGG | | |
| L406G | GGT | V414Y | TAT | C423M | ATG | A432F | TTT | T440S | AGT | | |
| L406I | ATT | K415A | GCG | C423P | CCT | A432G | GGG | T440V | GTG | | |
| L406N | AAT | K415C | TGT | C423Q | CAG | A432H | CAT | T440Y | TAT | | |
| | | K415D | GAT | C423R | AGG | A432I | ATT | E441A | GCT | | |
| | | K415E | GAG | C423S | TCG | A432K | AAG | E441C | TGT | | |

2. Expression

For expression of each mutant, HZ24-PH20-IRES-SEAP plasmid DNA containing cDNA encoding one of the variant PH20 or encoding wildtype PH20 was transfected into monolayer CHO—S cells (Invitrogen, Cat. No. 11619-012) using Lipofectamine 2000 (Invitrogen, Cat. No. 11668-027) according to the protocol suggested by the manufacturer. CHO—S cells were seeded the night before transfection and grown in DMEM with 10% FBS to be 80% confluent the next day. Then, the medium of the CHO—S cells was replaced with Opti-MEM. A mixture of plasmid DNA and lipofectamine was made (0.2 µg DNA and 0.5 µL Lipofetamine). The Lipofectamine/DNA mixture was added to CHO—S cells and incubated overnight. The next day, the cells were supplemented with CD-CHO serum free medium (Invitrogen, Cat. No. 10743-029). Supernatant from transfected cells was collected at various time points after transfection, and generally 96 hours after transfection. The supernatant, containing the variant PH20 protein or wildtype PH20 having a sequence of amino acids set forth in SEQ ID NO:3, was stored at −20° C. Activities of the supernatants were screened as described in the following examples.

Example 3

Screening of Library with a Hyaluronidase Activity Assay to Identify Activity Mutants In this example, supernatants of expressed PH20 variants generated in Example 2 were screened using a hyaluronidase activity assay to assess activity of each mutant. In addition, activity of the secreted alkaline phosphatase (SEAP) was also measured to allow for normalizing PH20 activity of the expressed mutants to the PH20 wildtype. Active and inactive mutants were identified.

1. Generation of Biotinylated HA (bHA) Substrate

A 1.2-MDa FLA (Lifecore) was biotinylated for use as a substrate in the hyaluronidase activity assay. First, 1.2 grams (g) of 1.2 MDa HA was dissovled at 4° C. in 600 mL ddH$_2$O for a week at a concentration of 2 mg/mL with stirring. Next, 645.71 mg Biotin Hydrazide was dissolved in 100 mL DMSO to a concentration of 25 mM (6.458 mg/mL, 247.8 mg in 38.37 mL DMSO). The biotin solution was warmed briefly at 37° C. until the solution was clear. Also, 368.61 mg Sulfo-NHS in 20 mL ddH$_2$O was dissolved to make a 100× solution (18.4 mg/mL Sulfo-NHS). A 30 mM (1000×) water-soluble carbodiimide EDC solution was made by dissolving 17.63 mg EDC in 3 mL ddH20 at a concentration of 5.7513 mg/mL right before the reaction was started.

To four (4) 1000-mL sterile capped bottles, the following components were added at room temperature (RT) and in the following order with stirring: 1) 200 mL of 2 mg/mL HA solution; 2) 80 mL of 0.5M MES, pH 5.0 with gentle mixing; and 3) 91.6 mL of ddH$_2$O with gentle mixing. Next, 24 mL of 25 mM Biotin-Hydrazide and 4 mL of 100× Sulfo-NHS solution were added sequentially, immediately followed by the addition of 500 µL EDC. After the addition of each component, the solution was mixed by inverting three times and stirring. After the addition of the last component, the solution was mixed by stirring overnight at 4° C. Then, Guanidine hydrochloride was added to a final concentration of 4 M by adding 38.2 g per 100 mL and was allowed to dissolve completely before adjusting the solution volume to 600 mL with ddH$_2$O.

For dialysis, 200 mL from each batch of the conjugated HA guanidine hydrochloride solution was transferred into dialysis membranes. Over the course of three days, the solution was dialyzed against ddH$_2$O with a change in ddH$_2$O at least six times. The resulting volume of about 840 mL was adjusted to a final volume of 1000 mL with ddH$_2$O. The final concentration of the biotinylated hyaluronan (bHA) was 0.4 mg/mL.

2. Hyaluronidase Activity Assay

The enzyme assay was a modification of the method described by Frost et al. (1997) (A Microtiter-Based Assay for Hyaluronidase Activity Not Requiring Specialized Reagents. Analytical Biochemistry (1997) 251:263-269) that provides a measure of PH20 hyaluronidase activity.

First, biotinylated HA (bHA) substrate was bound to plastic microtiter plates to generate assay plates. Briefly, 100 µl of b-HA at 1 mg/mL in 0.5 M carbonate buffer (pH 9.6) was dispensed into each well of a high bind microplate (Immunolon 4 HBX extra high binding; Thermo Scientific). The plate was covered with a plate sealer and stored between 2-8° C. for 24-48 hours.

Then, the assay plate was washed with 1× phosphate buffered saline (PBS) wash buffer containing 0.05% (v/v) Tween 20 (PBST). PBST was generated from 1×PBS (generated from Catalog No. P5368, Sigma (10 mM Phosphate Buffer, 2.7 mM Potassium Chloride, 137 mM Sodium Chloride, pH 7.4) by placing the contents of one packet of PBS into a 1-L graduated cylinder with 800 mL deionized water, dissolved by stirring or shaking and adding sufficient quantity of water to 1 L) by adding 500 µl Tween 20 (Catalog No. 6505; EMD Bioscience) to 900 mL of 1×PBS and adding sufficient quantity of water to 1 L. Washing was done using the BioTek ELx405 Select CW plate washer (BioTek) by washing five (5) times with 300 µl PBST wash buffer per well for each wash. At the end of each wash, the plate was tapped on a paper towel to remove excess liquid from each well. Prior to incubation with samples, 200 µl Blocking Buffer (1.0% w/v Bovine Serum Albumin (BSA) in PBS) was added to each well and the assay plate was incubated at 37° C. for approximately 1 hour prior. The Blocking buffer was generated by adding 2.5 g of BSA (Catalog No. 001-000-162; Jackson Immuno Research) to 200 mL 1×PBS, stirring, adding a sufficient quantity of 1×PBS to 250 mL and filtering through an 0.2 µM PES filter unit.

Transfected variant or wildtype PH20 supernatants generated as described in Example 1 were diluted in duplicate 1:25 in assay diluent buffer (pH 7.4 HEPES buffer; 10 mM HEPES, 50 mM NaCl, 1 mM CaCl$_2$, 1 mg/mL BSA, pH 7.4°, 0.05% Tween-20) in uncoated 4×HB high bound microplates. For the standard curve, 1:3 serial dilutions of rHuPH20 (generated as described in Example 1 with a specific activity of 145 U/mL) were made in assay diluent buffer in duplicate starting from 3 U/mL for standards as follows: 3 U/mL, 1 U/mL, ⅓ U/mL, ⅑ U/mL, 1/27 U/mL, 1/81 U/mL, and 1/243 U/mL. One hundred microliters (100 µl) of each standard and sample were transferred to the assay plates and incubated for approximately 1.5 hours at 37° C.

After the incubation, the plate was washed with PBST using the BioTek ELx405 Select CW plate washer by washing five (5) times with 300 µl PBST wash buffer per well for each wash. At the end of each wash, the plate was tapped on a paper towel to remove excess liquid from each well. Then, 100 µl of 1:5000 diluted Streptavidin-HRP (SA-HRP) was added to each well of the plate and incubated at ambient temperature for approximately 1 hour. For the dilution, a 1 mg/mL stock of Streptavidin-HRP conjugate (Catalog No. 21126; Thermo Scientific) was diluted 1:5000 into dilution buffer (1 mg/mL BSA, 0.025% Tween20, 137 mM NaCl, 20 mM Tris pH 7.5). After the incubation, the plate was washed with PBST using the BioTek ELx405 Select CW plate washer by washing five (5) times with 300 µl PBST wash buffer per well for each wash. At the end of each wash, the plate was tapped on a paper towel to remove excess liquid from each well. Then, 100 µl of TMB solution (Catalog No. 52-00-03, KPL; ambient temperature and protected from light) was added to each well for approximately five (5) minutes at room temperature or until an optimal color development was yielded. To stop the reaction, 100 µl 1.0 N Sulfuric Acid or TMB Stop solution (Catalog No. 50-85-06) were added to each well and the plates tapped to mix. Optical density was measured at 450 nm within 30 minutes of adding the stop solution. Since more PH20 in a standard or sample would lead to less bHA available to bind SA-HRP, the optical density (450 nm) value was inversely proportional to the concentration of hyaluronidase activity in each specimen.

3. SEAP Activity

Activity of secreted alkaline phosphatase (SEAP) in the cell culture supernatant also was measured using a colorimetric assay of placental alkaline phosphatase using pNPP as a phosphatase substrate (Anaspec SensoLyte pNPP SEAP kit; Catalog No. 72144, Anaspec) according to the manufacturer's instructions. The absorbance signal was measured at optical density (OD) of 405 nm.

The criteria for the high throughput (HTP) screening were that the transfected supernatant resulted in a SEAP signal of ≥0.1 and the signal for the rHuPH20 wildtype control produced a signal of ≥1 U/mL. Also, the criteria for each screen were that the standard curves had a signal to noise ratio (S/N) for the 0 U/mL standard versus the 3 u/mL standard at OD$_{405}$ of ≥5, had less than three (3) standards with a coefficient of variation (CV) ≥10%, and at least four (4) of the standards were in the linear range.

Example 4

Selected PH20 Variants with Altered Hyaluronidase Activity

Each generated variant was screened for hyaluonidase activity as described in Example 3. The SEAP expression was used to normalize PH20 activity of each variant to the PH20 wildtype. Mutants were identified that exhibited altered hyaluronidase activity compared to wildtype.

1. Active Mutants

Active mutants were selected whereby at least one duplicate sample exhibited greater than 40% of wildtype activity when normalized to SEAP activity. The identified active mutants are set forth in Table 9. The Table sets forth the amino acid replacement compared to the sequence of amino acids of PH20 set forth in SEQ ID NO:3. The amino acid sequence of exemplary mutants also is set forth by reference to a SEQ ID NO. The Table also sets forth the average hyaluronidase activity of tested duplicates normalized by SEAP values compared to average of wildtype PH20 activities in each plate, which were also normalized by their own SEAP values. For example, a value of 0.40 indicates that the variant exhibits 40% of the hyaluronidase activity of wildtype PH20, a value of 1 indicates that the variant exhibits a similar hyaluronidase activity of wildtype and a value of 3.00 indicates that the variant exhibits 300% of the hyaluronidase activity of wildtype PH20 or 3-fold increased activity compared to wildtype.

The results in Table 9 show that over 600 tested mutants exhibit activity that is increased compared to wildtype. For example, about 536 mutants exhibit 120% or greater than 120% of the hyaluronidase activity of wildtype PH20 and about 75 of the mutants exhibit 300% or greater than 300% of the hyaluronidase activity of wildtype PH20. In particular, the results in Table 9 show that that hyaluronidase activity compared to wildtype of mutant S69A is about 22-fold; mutant S69R is about 14-fold; mutant I70A is about 27-fold; mutant I70K is about 14-fold; mutant I70R is about 14-fold; and mutant I271L is about 10-fold.

TABLE 9

ACTIVE MUTANTS

| mutant | SEQ ID NO | AvgNorm Act. |
|---|---|---|
| L001A | 74 | 0.95 |
| L001C |  | 0.89 |
| L001E | 75 | 0.55 |
| L001F |  | 0.41 |
| L001G | 76 | 0.62 |
| L001H | 73 | 1.90 |
| L001K | 77 | 1.39 |
| L001N |  | 0.87 |
| L001P |  | 0.92 |
| L001Q | 78 | 3.27 |
| L001R | 79 | 0.72 |
| L001S |  | 0.74 |
| L001T |  | 0.99 |
| L001V |  | 1.00 |
| L001W |  | 0.88 |
| N002A |  | 0.61 |
| N002C |  | 0.4 |
| G291C |  | 0.27 |
| N002G |  | 0.44 |

TABLE 9-continued

ACTIVE MUTANTS

| mutant | SEQ ID NO | AvgNorm Act. |
|---|---|---|
| N002L | | 0.46 |
| N002P | | 0.54 |
| N002Q | | 0.84 |
| N002S | | 0.78 |
| N002T | | 1.05 |
| N002V | | 0.65 |
| F003E | | 0.42 |
| F003H | | 0.68 |
| F003L | | 0.59 |
| F003Y | | 0.50 |
| R004A | | 0.73 |
| R004I | | 0.54 |
| R004S | | 0.60 |
| R004T | | 0.66 |
| R004V | | 1.09 |
| A005H | | 0.44 |
| P006A | 80 | 0.78 |
| P006H | | 0.58 |
| P006K | | 0.80 |
| P006L | | 0.76 |
| P006N | | 0.40 |
| P006Q | | 0.89 |
| P006R | | 0.56 |
| P007M | | 0.57 |
| V008I | | 1.17 |
| V008L | | 0.53 |
| V008M | 81 | 0.47 |
| V008P | | 0.33 |
| I009K | | 0.69 |
| I009L | | 1.08 |
| I009R | | 0.53 |
| I009S | | 0.98 |
| I009V | | 0.84 |
| P010D | | 0.62 |
| P010E | | 0.66 |
| P010G | 83 | 0.55 |
| P010H | 84 | 0.43 |
| P010N | | 0.55 |
| P010Q | | 0.89 |
| P010R | | 0.73 |
| P010S | | 0.55 |
| P010W | | 0.59 |
| N011D | | 0.54 |
| N011G | | 0.45 |
| N011H | | 0.69 |
| N011K | | 0.58 |
| N011S | 85 | 0.39 |
| M310F | | 0.30 |
| V012A | | 0.56 |
| V012E | 86 | 1.86 |
| V012I | 87 | 0.68 |
| V012K | 88 | 0.65 |
| V012L | | 0.44 |
| V012N | | 0.46 |
| V012R | | 0.50 |
| V012S | | 0.75 |
| V012T | 89 | 1.50 |
| P013H | | 0.46 |
| P013S | | 0.68 |
| P013T | | 0.90 |
| P013Y | | 0.51 |
| F014D | | 0.64 |
| F014I | | 0.42 |
| F014M | | 0.47 |
| F014V | 90 | 0.46 |
| L015A | | 0.65 |
| L015M | 92 | 0.45 |
| L015V | 91 | 2.20 |
| A020S | 93 | 0.50 |
| S022H | | 0.57 |
| S022M | | 0.49 |
| S022T | 94 | 0.48 |
| S022Y | | 0.45 |
| E023D | | 0.97 |
| F024A | | 0.69 |
| F024E | 95 | 3.99 |
| F024G | | 0.75 |
| F024H | 96 | 2.07 |
| F024I | | 0.70 |
| F024K | | 0.96 |
| F024L | | 0.62 |
| F024M | | 0.85 |
| F024N | | 0.60 |
| F024R | 97 | 1.22 |
| F024T | | 1.18 |
| F024V | | 1.15 |
| F024Y | | 0.90 |
| L026A | 98 | 1.30 |
| L026E | 99 | 3.22 |
| L026G | | 0.81 |
| L026H | | 0.97 |
| L026I | | 0.51 |
| L026K | 100 | 1.88 |
| L026M | 101 | 1.43 |
| L026P | | 0.55 |
| L026Q | 102 | 1.44 |
| L026R | 103 | 1.43 |
| L026S | | 0.78 |
| L026T | | 0.87 |
| L026V | | 0.52 |
| L026W | | 0.53 |
| L026Y | | 0.52 |
| G027A | | 0.79 |
| G027D | 104 | 1.22 |
| G027E | | 1.18 |
| G027F | | 0.61 |
| G027H | | 1.11 |
| G027I | | 0.41 |
| G027K | 105 | 2.71 |
| G027L | | 0.76 |
| G027P | | 0.46 |
| G027Q | | 1.12 |
| G027R | 106 | 1.88 |
| G027S | | 0.94 |
| G027T | | 0.61 |
| G027W | | 0.76 |
| K028A | | 0.78 |
| K028D | | 0.62 |
| K028E | | 0.54 |
| K028F | | 0.75 |
| K028I | | 0.55 |
| K028L | | 0.51 |
| K028M | | 0.67 |
| K028N | | 0.58 |
| K028P | | 0.40 |
| K028R | 107 | 0.71 |
| K028S | | 0.46 |
| K028T | | 0.68 |
| K028V | | 0.76 |
| K028W | | 0.51 |
| F029A | | 0.90 |
| F029E | 108 | 4.03 |
| F029G | | 1.05 |
| F029H | | 0.82 |
| F029I | 109 | 1.53 |
| F029K | 110 | 1.34 |
| F029L | 111 | 2.36 |
| F029M | 112 | 2.08 |
| F029P | 113 | 3.79 |
| F029R | 114 | 1.24 |
| F029S | 115 | 2.21 |
| F029T | 116 | 0.85 |
| F029V | 117 | 1.65 |
| F029W | | 0.48 |
| D030A | | 1.12 |
| D030F | | 0.84 |

TABLE 9-continued

ACTIVE MUTANTS

| mutant | SEQ ID NO | AvgNorm Act. |
|---|---|---|
| D030G | 118 | 2.02 |
| D030H | 119 | 1.69 |
| D030K | 120 | 2.63 |
| D030L | 121 | 1.32 |
| D030M | 122 | 1.85 |
| D030P | | 1.19 |
| D030Q | | 0.84 |
| D030R | 123 | 1.82 |
| D030S | 124 | 1.62 |
| D030T | | 0.57 |
| D030V | | 0.46 |
| D030W | | 0.62 |
| E031A | 125 | 2.05 |
| E031C | 126 | 2.95 |
| E031G | 127 | 1.27 |
| E031H | 128 | 2.74 |
| E031I | 129 | 3.89 |
| E031K | 130 | 3.13 |
| E031L | 131 | 2.62 |
| E031P | 132 | 1.51 |
| E031R | 133 | 2.27 |
| E031S | 134 | 1.70 |
| E031T | 135 | 3.96 |
| E031V | 136 | 4.57 |
| E031W | 137 | 1.26 |
| E031Y | | 1.13 |
| P032A | | 0.92 |
| P032C | 138 | 0.40 |
| P032F | 139 | 2.71 |
| I326C | | 0.39 |
| I331C | | 0.27 |
| P032G | 140 | 1.60 |
| P032H | 141 | 2.08 |
| P032K | | 1.04 |
| P032L | | 0.82 |
| P032M | | 0.67 |
| P032N | | 0.70 |
| P032Q | | 1.11 |
| P032R | | 1.17 |
| P032S | | 1.01 |
| P032T | | 0.77 |
| P032V | | 0.81 |
| P032W | | 0.54 |
| P032Y | | 1.01 |
| L033G | 143 | 0.57 |
| L033M | | 0.69 |
| L033P | | 0.87 |
| L033Q | | 0.45 |
| L033R | | 0.61 |
| L033S | | 0.48 |
| L033T | | 0.45 |
| L033W | 142 | 1.58 |
| D034A | | 0.38 |
| D034E | | 0.58 |
| D034H | | 0.41 |
| D034K | | 0.54 |
| D034Q | | 0.59 |
| D034R | | 1.17 |
| D034W | 144 | 0.46 |
| M035F | | 0.87 |
| M035H | | 0.60 |
| M035L | | 0.52 |
| M035T | | 0.83 |
| M035Y | | 0.78 |
| S036A | | 0.45 |
| S036D | | 0.32 |
| S036G | | 0.64 |
| S036H | 147 | 0.54 |
| S036K | | 0.83 |
| S036L | | 0.71 |
| S036R | | 1.09 |
| Q347L | | 0.39 |
| V351Q | | 0.34 |
| S036T | | 0.51 |
| L037F | 149 | 3.33 |
| L037I | | 0.62 |
| L037K | | 0.43 |
| L037M | 150 | 1.46 |
| L037P | | 0.63 |
| L037R | | 0.51 |
| L037V | | 0.57 |
| F038Y | 151 | 1.29 |
| S039A | 152 | 1.06 |
| S039L | 153 | 0.80 |
| S039N | 154 | 2.32 |
| S039Q | | 1.10 |
| S039R | | 0.56 |
| S039T | 155 | 1.57 |
| S039Y | | 0.56 |
| F040L | 156 | 0.92 |
| F040W | | 1.11 |
| I041A | | 0.67 |
| I041C | | 0.53 |
| I041D | | 0.78 |
| I041E | | 0.51 |
| I041G | | 0.76 |
| I041H | | 0.77 |
| I041N | | 0.40 |
| I041T | 157 | 1.47 |
| I041V | | 0.73 |
| I041W | | 0.66 |
| G042A | | 0.64 |
| S043T | | 0.43 |
| P044E | | 0.59 |
| R045I | | 0.45 |
| R045K | | 0.53 |
| I046A | | 1.04 |
| I046C | | 0.37 |
| I046E | | 0.43 |
| I046F | | 0.73 |
| I046H | | 0.82 |
| I046L | 158 | 1.08 |
| I046M | | 1.00 |
| I046N | | 0.66 |
| I046R | 159 | 2.29 |
| I046S | | 0.64 |
| I046T | | 0.55 |
| I046V | | 1.01 |
| I046Y | | 0.76 |
| N047A | | 0.48 |
| N047D | 160 | 0.82 |
| N047F | 161 | 1.32 |
| N047G | | 0.82 |
| N047H | | 1.16 |
| N047K | | 0.67 |
| N047M | | 0.77 |
| N047Q | | 0.69 |
| N047R | | 0.84 |
| N047S | | 0.85 |
| N047T | 162 | 1.49 |
| N047W | 163 | 0.63 |
| N047Y | | 0.45 |
| A048F | 164 | 2.51 |
| A048G | | 0.83 |
| A048H | 165 | 1.99 |
| A048I | | 0.64 |
| A048K | 166 | 1.28 |
| A048M | | 0.76 |
| A048N | 167 | 4.25 |
| A048Q | | 1.05 |
| A048R | | 0.66 |
| A048S | | 1.06 |
| A048V | | 0.60 |
| A048Y | | 0.81 |
| T049I | | 0.42 |
| T049K | | 0.85 |
| T049R | 168 | 1.41 |
| T049S | | 0.92 |

TABLE 9-continued

ACTIVE MUTANTS

| mutant | SEQ ID NO | AvgNorm Act. |
|---|---|---|
| T049V | | 0.45 |
| G050A | | 0.93 |
| G050C | | 0.41 |
| G050D | 169 | 1.37 |
| G050E | | 0.78 |
| G050H | | 0.74 |
| G050L | | 0.43 |
| G050M | 171 | 0.47 |
| G050Q | | 0.86 |
| G050R | | 0.86 |
| G050S | 170 | 1.24 |
| G050V | | 0.3 |
| G050Y | | 0.58 |
| Q051N | | 0.60 |
| Q051S | | 0.46 |
| G052N | 172 | 0.89 |
| G052P | | 0.43 |
| G052Q | 173 | 3.71 |
| G052R | 174 | 0.53 |
| G052S | 175 | 1.32 |
| E375I | | 0.36 |
| F380V | | 0.39 |
| G052T | 176 | 0.49 |
| T054A | | 0.43 |
| T054F | | 0.56 |
| T054N | | 0.48 |
| T054Q | | 0.91 |
| T054S | | 0.70 |
| T054V | | 0.66 |
| V058C | 177 | 0.55 |
| V058G | | 0.54 |
| V058H | 183 | 1.09 |
| V058I | | 0.57 |
| V058K | 178 | 4.08 |
| V058L | 179 | 1.54 |
| V058N | 184 | 0.49 |
| V058P | 180 | 0.90 |
| V058Q | 181 | 4.54 |
| V058R | 182 | 1.92 |
| V058S | | 0.83 |
| V058W | | 0.65 |
| V058Y | 185 | 1.07 |
| D059Q | | 0.40 |
| D059N | 186 | 1.27 |
| R060K | | 0.69 |
| L061I | | 0.42 |
| L061M | | 0.73 |
| L061V | | 0.59 |
| Y063A | | 0.63 |
| Y063H | | 1.07 |
| Y063I | | 1.03 |
| Y063K | 187 | 1.36 |
| Y063L | 188 | 1.33 |
| Y063M | 189 | 1.32 |
| Y063N | | 0.96 |
| Y063R | 190 | 1.40 |
| Y063S | | 1.00 |
| Y063T | | 1.07 |
| Y063V | | 0.43 |
| Y063W | 191 | 1.53 |
| P065R | | 0.57 |
| Y066H | | 0.47 |
| Y066R | | 0.51 |
| I067F | | 1.00 |
| I067L | | 0.45 |
| I067R | | 0.24 |
| I067V | 192 | 1.80 |
| I067Y | | 0.55 |
| D068E | | 0.72 |
| D068H | 193 | 2.06 |
| D068K | | 1.08 |
| D068L | | 0.43 |
| D068P | 194 | 0.50 |
| D068Q | 195 | 1.67 |
| D068R | | 0.70 |
| D068S | | 0.81 |
| D068T | | 0.75 |
| S069A | 196 | 22.06 |
| S069C | 197 | 1.97 |
| S069E | 198 | 1.48 |
| S069F | 199 | 8.75 |
| S069G | 200 | 6.06 |
| S069I | 201 | 3.12 |
| S069L | 202 | 3.44 |
| S069M | 203 | 2.67 |
| S069P | 204 | 8.14 |
| S069R | 205 | 14.06 |
| S069T | 206 | 0.58 |
| S069W | 207 | 2.18 |
| S069Y | 208 | 2.71 |
| I070A | 209 | 27.00 |
| I070C | 210 | 2.57 |
| I070F | 211 | 5.69 |
| I070G | 212 | 6.22 |
| I070H | 213 | 9.09 |
| I070K | 214 | 14.64 |
| I070L | 215 | 3.05 |
| I070N | 216 | 6.19 |
| I070P | 217 | 3.03 |
| I070R | 218 | 13.95 |
| I070S | 219 | 3.63 |
| I070T | 220 | 5.43 |
| I070V | 221 | 6.34 |
| I070Y | 222 | 1.26 |
| T071A | | 0.86 |
| T071D | | 0.50 |
| T071G | 223 | 1.41 |
| T071H | | 0.93 |
| T071L | | 1.09 |
| T071M | | 0.89 |
| T071N | 224 | 1.21 |
| T071Q | | 0.68 |
| T071R | 225 | 2.17 |
| T071S | 226 | 1.54 |
| G072A | | 0.45 |
| G072D | | 0.60 |
| S395W | | 0.4 |
| G072E | | 0.69 |
| G072H | | 0.46 |
| G072K | 227 | 1.39 |
| G072L | | 0.43 |
| G072M | 228 | 3.11 |
| G072Q | 229 | 2.33 |
| G072R | | 0.65 |
| G072S | | 0.51 |
| V073A | 230 | 1.38 |
| V073C | | 0.84 |
| V073D | | 0.94 |
| V073G | | 1.17 |
| V073H | 231 | 1.54 |
| V073K | 232 | 1.42 |
| V073L | 233 | 1.59 |
| V073M | | 0.68 |
| V073Q | 234 | 0.96 |
| V073R | 235 | 0.72 |
| V073S | | 0.86 |
| K297R | | 0.34 |
| S401Q | | 0.39 |
| V073T | 236 | 1.34 |
| V073W | 237 | 1.91 |
| T074A | 238 | 2.28 |
| T074C | 239 | 2.18 |
| T074E | 240 | 1.38 |
| T074F | 241 | 1.43 |
| T074G | 242 | 2.75 |
| T074H | 243 | 1.40 |
| T074K | 244 | 1.29 |

TABLE 9-continued

ACTIVE MUTANTS

| mutant | SEQ ID NO | AvgNorm Act. |
|---|---|---|
| T074L | 245 | 1.43 |
| T074M | 246 | 0.52 |
| T074N | 247 | 2.12 |
| T074P | 248 | 2.45 |
| T074R | 249 | 2.22 |
| T074S | 250 | 1.80 |
| T074V | 251 | 2.27 |
| T074W | 252 | 2.13 |
| V075A | | 0.71 |
| V075C | | 0.46 |
| V075F | 253 | 2.00 |
| V075H | | 0.62 |
| V075L | 254 | 5.22 |
| V075M | 255 | 1.16 |
| V075N | | 0.81 |
| V075Q | | 1.51 |
| V075R | 256 | 3.02 |
| V075S | | 0.76 |
| V075T | 257 | 4.34 |
| V075Y | | 0.63 |
| G077H | | 0.32 |
| I079L | 258 | 1.44 |
| I079T | | 0.79 |
| I079V | | 1.01 |
| Q081P | | 0.60 |
| K082A | | 0.94 |
| K082E | | 0.50 |
| K082G | | 0.64 |
| K082H | | 0.44 |
| K082I | | 1.01 |
| K082L | 259 | 0.87 |
| K082M | | 0.58 |
| K082N | 260 | 0.96 |
| K082Q | | 0.76 |
| K082R | | 0.85 |
| K082S | | 0.62 |
| K082T | | 0.56 |
| K082Y | | 0.32 |
| K082V | | 0.57 |
| I083F | | 0.57 |
| I083G | 264 | 1.05 |
| I083L | | 0.93 |
| I083N | | 0.82 |
| I083Q | 262 | 1.07 |
| I083R | | 0.45 |
| I083S | 263 | 0.79 |
| I083T | | 0.95 |
| I083V | 261 | 0.99 |
| S084D | | 0.98 |
| S084E | 265 | 0.52 |
| S084F | 266 | 0.72 |
| S084G | 267 | 8.68 |
| S084H | | 0.96 |
| S084I | | 0.90 |
| S084L | | 0.92 |
| S084M | | 0.77 |
| S084N | 268 | 0.89 |
| S084P | | 0.57 |
| S084Q | | 0.86 |
| S084R | 269 | 1.89 |
| S084T | | 0.82 |
| S084W | | 0.86 |
| S084Y | | 0.30 |
| S221I | | 0.35 |
| L085V | | 0.42 |
| Q086A | 270 | 2.70 |
| Q086D | | 0.88 |
| Q086E | | 1.18 |
| Q086F | | 0.54 |
| Q086G | | 1.02 |
| Q086H | 271 | 1.70 |
| Q086I | | 0.65 |
| Q086K | 272 | 0.97 |
| Q086L | | 0.92 |
| Q086M | | 1.06 |
| Q086N | 273 | 1.28 |
| Q086P | | 0.42 |
| Q086R | | 0.93 |
| Q086S | 274 | 0.85 |
| Q086T | 275 | 0.58 |
| Q086V | | 0.97 |
| Q086W | 276 | 1.21 |
| D087A | | 1.00 |
| D087C | 277 | 1.77 |
| D087E | | 0.86 |
| D087G | 278 | 1.00 |
| D087H | | 0.72 |
| D087I | | 0.53 |
| D087L | 279 | 0.55 |
| D087M | 280 | 0.58 |
| D087P | | 0.31 |
| D087Q | | 1.05 |
| D087R | 281 | 1.28 |
| D087S | 282 | 0.99 |
| D087T | 283 | 1.70 |
| A412H | | 0.39 |
| D413H | | 0.31 |
| V414K | | 0.3 |
| K415V | | 0.39 |
| D087V | 284 | 0.66 |
| D087Y | 285 | 2.72 |
| L089C | 286 | 1.46 |
| L089R | | 0.34 |
| L089K | | 0.45 |
| L089M | | 0.63 |
| D090A | 287 | 1.48 |
| D090E | 288 | 1.15 |
| D090G | | 0.41 |
| D090H | 289 | 1.24 |
| D090I | | 1.10 |
| D090K | 290 | 1.36 |
| D090L | | 1.15 |
| D090N | 291 | 1.18 |
| D090Q | | 1.11 |
| D090R | 292 | 1.49 |
| D090S | | 1.15 |
| D090T | | 1.02 |
| D090W | | 0.81 |
| K091A | | 0.89 |
| K091Q | | 0.43 |
| K091R | | 0.67 |
| A092C | 293 | 1.97 |
| A092H | | 0.22 |
| A092L | 294 | 1.29 |
| A092M | | 0.86 |
| A092T | | 0.70 |
| A092V | | 1.09 |
| K093D | | 0.71 |
| K093E | | 0.83 |
| K093F | | 0.50 |
| K093G | | 0.97 |
| K093H | | 0.61 |
| K093I | 295 | 3.25 |
| R248H | | 0.4 |
| K093L | 296 | 1.53 |
| K093M | | 0.70 |
| K093N | | 0.71 |
| K093Q | 297 | 0.84 |
| K093R | 298 | 1.52 |
| K093S | 299 | 1.25 |
| K093T | 300 | 3.93 |
| K093V | | 0.24 |
| K094A | | 0.64 |
| K094D | 301 | 0.93 |
| K094E | | 0.79 |
| K094F | | 0.59 |

TABLE 9-continued

ACTIVE MUTANTS

| mutant | SEQ ID NO | AvgNorm Act. |
|---|---|---|
| K094H | | 0.72 |
| K094L | | 0.52 |
| K094M | | 0.66 |
| K094N | | 0.99 |
| K094Q | 302 | 1.22 |
| K094R | 303 | 3.94 |
| K094S | | 0.94 |
| K094T | | 1.14 |
| I096D | | 0.69 |
| I096L | | 0.46 |
| I096V | | 0.68 |
| T097A | 304 | 1.25 |
| T097C | 305 | 0.53 |
| T097D | 306 | 1.31 |
| T097E | 307 | 1.19 |
| T097F | | 0.75 |
| P257C | | 0.36 |
| D426K | | 0.26 |
| G427H | | 0.35 |
| T097G | 308 | 4.84 |
| T097I | | 0.85 |
| T097L | 309 | 1.22 |
| T097N | | 1.10 |
| T097P | | 0.62 |
| T097Q | | 1.17 |
| T097R | | 0.95 |
| T097S | 310 | 1.21 |
| T097W | | 0.53 |
| T097Y | | 0.74 |
| F098A | | 0.60 |
| F098C | | 0.58 |
| F098D | | 0.47 |
| F098E | | 0.44 |
| F098H | | 1.06 |
| F098I | | 0.52 |
| F098L | | 0.58 |
| F098M | | 0.87 |
| F098Q | | 0.65 |
| P436C | | 0.39 |
| F098R | | 0.72 |
| F098S | | 0.56 |
| F098V | | 0.46 |
| F098W | | 0.81 |
| Y099A | | 0.33 |
| Y099R | | 0.53 |
| Y099S | | 0.43 |
| V102A | | 0.83 |
| V102C | | 0.69 |
| V102E | | 0.90 |
| V102G | | 0.67 |
| V102H | | 0.88 |
| V102K | | 1.03 |
| V102L | | 0.71 |
| V102M | | 0.77 |
| V102N | | 1.02 |
| V102Q | | 1.03 |
| V102R | | 0.94 |
| V102S | 311 | 1.41 |
| V102T | 312 | 1.26 |
| V102W | | 0.76 |
| D103N | | 0.39 |
| N104A | | 0.69 |
| N104C | | 0.41 |
| N104G | | 0.48 |
| N104K | | 0.88 |
| N104M | | 0.61 |
| N104R | 313 | 1.25 |
| N104S | | 1.03 |
| N104T | | 0.71 |
| L105A | | 0.54 |
| L105G | | 0.51 |
| L105I | | 0.94 |
| L105P | | 0.84 |
| L105Q | | 0.90 |
| L105R | | 0.65 |
| L105S | | 0.61 |
| L105T | | 0.51 |
| L105W | | 0.34 |
| L105V | | 0.99 |
| G106V | | 0.43 |
| M107F | | 0.91 |
| M107I | | 0.67 |
| M107L | 314 | 1.32 |
| A108G | | 0.47 |
| I110V | | 0.51 |
| E114A | 315 | 1.44 |
| E114G | | 0.73 |
| E114H | | 0.75 |
| E114M | | 0.44 |
| E114S | | 0.69 |
| P117D | | 0.56 |
| T118H | | 0.47 |
| T118K | | 0.53 |
| T118L | | 1.09 |
| T118M | | 0.53 |
| T118N | | 0.67 |
| T118Q | 316 | 3.37 |
| T118V | | 0.79 |
| W119F | | 0.53 |
| W119P | | 0.36 |
| W119Y | | 1.08 |
| A120D | | 0.76 |
| A120F | 318 | 2.62 |
| A120G | | 1.03 |
| A120H | 317 | 1.11 |
| A120I | 319 | 1.33 |
| A120L | | 1.25 |
| A120N | | 0.81 |
| A120P | | 0.42 |
| A120R | | 0.82 |
| A120S | 320 | 1.21 |
| A120T | | 0.62 |
| A120V | 321 | 1.53 |
| A120W | | 0.59 |
| A120Y | 322 | 1.95 |
| N122M | | 0.56 |
| K124L | | 0.34 |
| K124R | | 0.62 |
| P125H | | 0.43 |
| P125R | | 0.63 |
| P125S | | 0.54 |
| D127A | | 0.89 |
| D127E | 323 | 1.31 |
| D127G | | 0.97 |
| D127H | 324 | 2.33 |
| D127L | | 0.84 |
| D127M | | 0.4 |
| D127N | 325 | 1.69 |
| D127Q | 326 | 1.21 |
| D127R | 327 | 0.51 |
| D127S | | 0.77 |
| D127T | | 1.11 |
| D127V | | 0.56 |
| D127W | | 0.44 |
| V128A | | 0.53 |
| V128C | | 0.68 |
| V128G | | 0.49 |
| V128I | 328 | 1.25 |
| V128K | | 1.16 |
| V128L | | 0.95 |
| V128Q | | 0.55 |
| V128R | | 0.74 |
| V128S | | 0.53 |
| V128W | | 0.50 |
| K130I | | 0.50 |
| K130R | 329 | 1.42 |
| N131C | | 0.60 |

TABLE 9-continued

ACTIVE MUTANTS

| mutant | SEQ ID NO | AvgNorm Act. |
|---|---|---|
| N131E |  | 0.44 |
| N131F |  | 0.63 |
| N131G | 330 | 2.47 |
| N131H |  | 0.80 |
| N131I | 331 | 1.40 |
| N131L |  | 0.82 |
| N131M | 332 | 0.99 |
| N131Q | 333 | 1.24 |
| N131R | 334 | 2.81 |
| N131S |  | 0.76 |
| N131T |  | 1.02 |
| N131V | 335 | 2.08 |
| N131Y |  | 0.85 |
| R132A |  | 0.68 |
| R132C |  | 0.58 |
| R132E |  | 0.70 |
| R132F |  | 0.60 |
| R132H |  | 0.66 |
| K279A |  | 0.27 |
| E285A |  | 0.34 |
| R132I |  | 0.56 |
| R132K |  | 1.05 |
| R132L | 337 | 0.76 |
| R132N | 336 | 1.28 |
| R132Q |  | 0.69 |
| R132S |  | 0.79 |
| R132T |  | 0.61 |
| R132V |  | 0.73 |
| R132Y |  | 0.78 |
| S133I |  | 0.54 |
| I134L |  | 1.04 |
| I134T |  | 0.60 |
| I134V |  | 1.08 |
| E135A |  | 0.99 |
| E135C |  | 0.77 |
| E135D | 338 | 2.68 |
| E135F |  | 0.73 |
| E442L |  | 0.4 |
| E135G | 339 | 2.79 |
| E135H |  | 0.79 |
| E135K |  | 1.15 |
| E135L |  | 0.82 |
| E135N |  | 0.56 |
| E135Q |  | 1.59 |
| E135R | 340 | 2.08 |
| E135S |  | 1.13 |
| E135W |  | 0.63 |
| E135Y |  | 0.50 |
| L136A |  | 0.73 |
| L136C |  | 0.56 |
| L136D |  | 0.47 |
| L136F |  | 0.96 |
| L136H |  | 1.00 |
| L136I |  | 0.65 |
| L136M |  | 1.05 |
| L136N |  | 0.48 |
| L136Q |  | 0.61 |
| L136R |  | 0.74 |
| L136S |  | 0.80 |
| L136T |  | 0.72 |
| L136W |  | 1.11 |
| V137A |  | 0.48 |
| V137I |  | 1.01 |
| V137T |  | 0.51 |
| Q138A |  | 0.69 |
| Q138C |  | 0.65 |
| Q138H |  | 0.71 |
| Q138I |  | 0.54 |
| Q138L | 341 | 0.59 |
| Q138M |  | 0.68 |
| Q138N |  | 0.61 |
| Q138R |  | 0.53 |
| Q138S |  | 0.48 |
| Q138W |  | 0.41 |
| Q138Y |  | 0.60 |
| Q139A |  | 0.92 |
| Q139C |  | 0.44 |
| Q139D |  | 0.48 |
| Q139E |  | 0.94 |
| Q139F |  | 0.53 |
| Q139G |  | 0.65 |
| Q139H |  | 0.56 |
| Q139K |  | 0.73 |
| Q139L |  | 0.70 |
| Q139M |  | 0.95 |
| Q139R |  | 0.79 |
| Q139S |  | 0.81 |
| Q139T | 342 | 1.31 |
| Q139V |  | 0.77 |
| Q140A |  | 0.96 |
| Q140C |  | 0.50 |
| Q140D |  | 0.59 |
| Q140F |  | 0.66 |
| Q140G |  | 0.73 |
| Q140H |  | 0.84 |
| Q140I |  | 0.75 |
| Q140K | 343 | 0.93 |
| Q140L |  | 0.51 |
| Q140M |  | 0.80 |
| Q140R |  | 0.85 |
| Q140V |  | 0.61 |
| Q140W |  | 0.59 |
| Q140Y |  | 0.41 |
| N141A |  | 1.12 |
| N141D |  | 1.09 |
| N141E |  | 0.67 |
| N141F |  | 0.81 |
| N141G |  | 1.15 |
| N141H | 344 | 2.03 |
| N002I |  | 0.37 |
| G297A |  | 0.57 |
| N141L |  | 0.61 |
| N141M |  | 0.48 |
| N141Q |  | 1.16 |
| N141R | 345 | 1.40 |
| N141S | 346 | 0.72 |
| N141T |  | 0.45 |
| N141V |  | 0.50 |
| N141W | 347 | 0.83 |
| N141Y | 348 | 1.55 |
| V142C |  | 0.61 |
| V142D | 349 | 0.71 |
| V142E |  | 0.87 |
| V142G | 350 | 0.98 |
| V142H |  | 1.11 |
| V142I |  | 0.81 |
| V142K | 351 | 1.40 |
| V142L |  | 0.75 |
| V142M |  | 0.76 |
| V142N | 352 | 0.98 |
| V142P | 353 | 0.88 |
| V142Q | 354 | 1.04 |
| V142R | 355 | 1.53 |
| V142S | 356 | 0.93 |
| V142T | 357 | 1.19 |
| Q143E |  | 0.77 |
| Q143G | 358 | 0.62 |
| Q143I |  | 0.44 |
| Q143K | 359 | 1.30 |
| I009Q | 82 | 0.4 |
| Q143L |  | 0.56 |
| Q143N |  | 0.73 |
| Q143V |  | 0.57 |
| L144T | 361 | 1.02 |
| L144W |  | 0.79 |
| S145A |  | 0.58 |
| S145C |  | 0.44 |
| S145D |  | 0.48 |

TABLE 9-continued

ACTIVE MUTANTS

| mutant | SEQ ID NO | AvgNorm Act. |
|---|---|---|
| S145E | | 0.56 |
| S145G | | 0.94 |
| S145H | | 0.56 |
| S145L | | 0.44 |
| S145M | | 0.56 |
| S145N | | 0.58 |
| S145P | | 1.04 |
| S145R | | 0.97 |
| L146A | | 0.52 |
| L146C | | 0.42 |
| G305N | | 0.36 |
| M310Y | | 0.38 |
| L146E | | 0.50 |
| L146G | | 0.62 |
| L146H | | 0.78 |
| L146I | | 0.82 |
| L146K | | 0.84 |
| L146N | | 0.57 |
| L146P | 362 | 0.93 |
| L146Q | | 0.84 |
| L146R | 363 | 1.47 |
| L146S | | 0.71 |
| L146T | | 0.74 |
| L146V | | 0.84 |
| L146Y | | 0.80 |
| S312K | | 0.38 |
| T147A | 364 | 1.20 |
| T147C | | 0.47 |
| T147D | | 0.71 |
| T147F | 365 | 1.24 |
| T147G | | 1.05 |
| T147I | | 0.85 |
| T147L | 366 | 1.30 |
| T147M | | 0.79 |
| T147P | | 1.09 |
| T147Q | | 1.29 |
| T147R | 367 | 2.11 |
| T147S | 368 | 1.27 |
| T147V | 369 | 2.04 |
| T147W | | 0.97 |
| T147Y | | 1.04 |
| E148C | | 0.66 |
| E148F | | 0.42 |
| E148G | | 1.05 |
| E148H | 370 | 1.24 |
| E148I | | 0.73 |
| E148K | 371 | 1.63 |
| E148L | | 0.85 |
| E148Q | 372 | 1.44 |
| E148R | | 0.97 |
| E148S | | 1.15 |
| E148T | | 0.82 |
| E148V | | 0.99 |
| E148W | | 0.43 |
| E148Y | | 0.95 |
| A149C | | 1.15 |
| A149G | | 0.52 |
| A149K | | 0.51 |
| A149L | | 0.88 |
| A149M | | 0.88 |
| A149Q | | 1.15 |
| A149R | | 1.02 |
| A149S | | 1.08 |
| A149T | 373 | 1.24 |
| A149V | 374 | 1.34 |
| T150A | 375 | 1.21 |
| T150C | | 0.70 |
| T150D | 376 | 1.24 |
| T150E | | 1.05 |
| T150F | | 0.71 |
| T150G | 377 | 2.19 |
| T150I | | 0.52 |
| T150L | | 0.70 |
| T150N | 378 | 0.91 |
| T150P | | 0.88 |
| T150R | | 0.90 |
| T150S | 379 | 0.92 |
| T150W | 380 | 1.25 |
| T150Y | 381 | 1.36 |
| E151A | 382 | 1.27 |
| E151C | | 1.00 |
| E151G | | 1.06 |
| E151H | 383 | 1.34 |
| E151K | 384 | 2.05 |
| E151L | 385 | 1.03 |
| E151M | 386 | 1.26 |
| E151N | | 0.95 |
| E151Q | 387 | 2.01 |
| D320L | | 0.37 |
| E151R | 388 | 1.61 |
| E151S | 389 | 1.28 |
| E151T | 390 | 1.21 |
| E151V | 391 | 1.38 |
| E151W | 392 | 1.31 |
| E151Y | 393 | 1.31 |
| K152A | | 0.51 |
| K152C | | 0.52 |
| K152F | | 0.61 |
| K152I | | 0.65 |
| K152M | | 0.75 |
| K152R | 394 | 1.85 |
| K152T | 395 | 1.20 |
| K152V | | 0.82 |
| K152Y | | 0.67 |
| A153I | | 0.93 |
| A153L | | 0.51 |
| K154R | | 0.86 |
| K154T | | 0.83 |
| K154V | | 0.46 |
| Q155A | | 0.91 |
| Q155C | | 0.60 |
| Q155D | 397 | 1.49 |
| Q155F | | 0.70 |
| Q155G | 398 | 1.61 |
| Q155H | | 1.03 |
| Q155K | 399 | 1.57 |
| Q155L | | 0.86 |
| Q155M | | 0.97 |
| Q155R | 400 | 1.27 |
| Q155S | | 0.77 |
| Q155T | | 0.76 |
| Q155V | | 0.73 |
| Q155W | | 0.91 |
| E156A | | 0.79 |
| E156D | 401 | 1.95 |
| E156G | | 0.49 |
| E156I | | 0.51 |
| E156L | | 0.43 |
| E156M | | 0.87 |
| E156Q | | 0.84 |
| E156R | | 0.43 |
| E156S | | 0.62 |
| E156T | | 0.69 |
| E156V | | 0.45 |
| E156W | | 0.49 |
| F157W | | 0.61 |
| E158A | | 0.56 |
| E158F | | 0.51 |
| E158H | | 0.54 |
| I326S | | 0.95 |
| I331E | | 0.34 |
| E158L | | 0.44 |
| E158Q | 402 | 1.25 |
| E158S | 403 | 0.95 |
| K159A | | 0.64 |
| K159D | | 0.52 |
| K159E | | 0.49 |

TABLE 9-continued

ACTIVE MUTANTS

| mutant | SEQ ID NO | AvgNorm Act. |
|---|---|---|
| K159H | | 0.74 |
| K159L | | 0.62 |
| K159M | | 0.66 |
| K159N | | 0.73 |
| K159Q | | 0.92 |
| K159R | | 0.88 |
| K159S | | 0.67 |
| K159V | | 0.41 |
| A160C | | 0.61 |
| A160F | | 0.79 |
| A160G | | 0.75 |
| A160H | | 0.47 |
| A160I | | 0.43 |
| A160K | | 0.91 |
| A160L | | 0.67 |
| M035Q | | 0.37 |
| A160M | | 0.77 |
| A160N | | 0.56 |
| A160Q | | 0.65 |
| A160R | | 0.89 |
| A160S | 404 | 1.35 |
| A160V | | 0.73 |
| A160Y | | 1.07 |
| G161A | | 0.99 |
| G161C | | 0.44 |
| G161D | | 0.86 |
| G161E | | 0.49 |
| G161R | | 0.48 |
| S036N | 148 | 0.38 |
| G161S | | 0.77 |
| G161V | | 0.42 |
| K162A | | 0.50 |
| K162D | | 0.77 |
| K162E | 405 | 0.51 |
| V351C | | 0.35 |
| W357K | | 0.36 |
| K162G | | 0.56 |
| K162H | | 0.62 |
| K162L | | 0.54 |
| K162M | | 1.04 |
| K162P | | 0.64 |
| K162Q | | 0.58 |
| K162R | | 0.52 |
| K162S | | 0.47 |
| K162V | | 0.52 |
| K162W | | 1.01 |
| K162Y | | 0.72 |
| D163A | 406 | 1.52 |
| D163E | 407 | 1.63 |
| D163G | | 1.15 |
| D163K | 408 | 1.90 |
| D163L | | 1.18 |
| D163Q | 409 | 1.40 |
| D163R | 410 | 1.80 |
| D163S | 411 | 1.34 |
| D163T | | 1.13 |
| D163V | | 0.76 |
| F164L | | 1.13 |
| F164M | 412 | 1.66 |
| F164V | 413 | 1.23 |
| S043N | | 0.34 |
| F164W | | 0.72 |
| L165A | | 0.48 |
| L165D | 414 | 5.79 |
| L165F | 415 | 1.23 |
| L165N | 416 | 2.19 |
| L165R | | 0.59 |
| L165S | 417 | 1.31 |
| L165V | 418 | 1.22 |
| L165W | | 1.14 |
| A371G | | 0.38 |
| L165Y | | 0.66 |
| V166A | 419 | 2.85 |
| V166C | | 1.16 |
| V166E | 420 | 1.28 |
| V166F | 421 | 1.67 |
| V166G | | 1.11 |
| V166H | 422 | 1.74 |
| V166L | 423 | 4.38 |
| V166Q | 424 | 3.61 |
| V166R | 425 | 5.56 |
| V166T | 426 | 4.26 |
| V166W | 427 | 1.26 |
| V166Y | 428 | 2.08 |
| E167A | | 0.84 |
| E167D | 429 | 0.69 |
| E167G | | 0.60 |
| E167H | | 0.89 |
| E167K | | 0.91 |
| E167M | | 0.87 |
| E167N | | 0.83 |
| E167P | | 0.58 |
| E167R | | 1.02 |
| E167S | | 1.17 |
| E167T | | 0.59 |
| E167Y | | 0.55 |
| T168H | | 0.46 |
| I169L | 430 | 2.08 |
| I169R | | 0.54 |
| I169V | | 0.74 |
| K170N | | 0.72 |
| K170R | 431 | 2.58 |
| K170V | | 0.58 |
| L171I | | 0.73 |
| L171V | | 0.64 |
| G172A | 432 | 1.20 |
| G172C | | 1.03 |
| K173N | | 0.44 |
| K173R | 433 | 0.82 |
| L174A | | 1.20 |
| L174G | 434 | 0.40 |
| L174K | 435 | 2.39 |
| L174M | | 0.79 |
| L174N | 436 | 1.36 |
| L174Q | | 0.99 |
| L174R | 437 | 1.50 |
| L174S | | 0.85 |
| L174T | 438 | 1.12 |
| L174V | | 0.62 |
| L174W | | 0.78 |
| L174Y | | 1.06 |
| L175E | | 0.43 |
| Q051A | | 0.34 |
| L175H | | 0.57 |
| L175T | 439 | 1.43 |
| L175V | | 0.94 |
| L175Y | | 0.66 |
| R176K | | 0.67 |
| N178G | | 0.85 |
| N178K | 440 | 0.85 |
| N178M | | 0.88 |
| K376L | | 0.37 |
| F380T | | 0.39 |
| N178R | 441 | 1.10 |
| H179A | | 1.06 |
| H179C | | 0.94 |
| H179E | | 0.62 |
| H179G | | 0.86 |
| H179I | | 0.90 |
| H179K | 442 | 1.39 |
| H179L | | 0.73 |
| H179M | | 0.63 |
| H179N | | 0.96 |
| H179P | | 0.44 |
| H179R | | 0.96 |
| H179S | | 0.51 |
| H179T | | 0.43 |
| H179V | | 0.42 |

TABLE 9-continued

ACTIVE MUTANTS

| mutant | SEQ ID NO | AvgNorm Act. |
|---|---|---|
| L180F | | 0.59 |
| L180G | | 0.62 |
| L180K | | 0.44 |
| L180M | | 0.64 |
| W181M | | 0.88 |
| L061F | | 0.3 |
| W181Q | | 0.88 |
| G182L | | 0.90 |
| Y183L | | 0.70 |
| F186Y | | 0.59 |
| H192S | | 0.49 |
| H192T | | 0.50 |
| H193G | | 0.68 |
| H193Q | 443 | 0.82 |
| H193S | | 0.42 |
| H193Y | | 0.58 |
| K195A | | 0.51 |
| K195G | | 0.45 |
| K195H | | 0.45 |
| K195I | | 0.50 |
| K195L | | 0.45 |
| K195N | 445 | 0.74 |
| K195Q | | 0.71 |
| K195R | | 0.85 |
| K195S | | 0.42 |
| K195T | 444 | 0.58 |
| K195W | | 0.49 |
| K196E | 446 | 0.43 |
| D068G | | 0.37 |
| K196G | | 0.41 |
| K196L | | 0.65 |
| K196R | 447 | 0.58 |
| K196S | | 0.68 |
| K196T | | 1.18 |
| K196W | | 0.55 |
| P197A | | 0.81 |
| P197D | | 0.58 |
| P197E | | 0.52 |
| P197F | | 0.48 |
| P197G | | 0.75 |
| P197H | | 0.62 |
| P197K | | 0.99 |
| P197L | | 0.56 |
| P197M | | 1.03 |
| P197Q | | 0.69 |
| P197R | | 0.58 |
| P197S | | 0.70 |
| P197T | | 0.41 |
| G198A | | 0.80 |
| G198D | 448 | 1.99 |
| G198E | | 0.49 |
| G198H | | 0.84 |
| G198L | | 0.48 |
| G198N | | 0.80 |
| G198Q | | 0.55 |
| G198R | | 0.58 |
| G198S | | 0.76 |
| G198T | | 0.41 |
| G198Y | | 0.81 |
| N200D | | 0.46 |
| S202M | | 0.40 |
| F204P | 449 | 0.63 |
| N205A | 450 | 1.30 |
| N205D | | 0.85 |
| N205E | 451 | 1.94 |
| N205F | | 0.52 |
| N205G | | 0.79 |
| N205K | | 0.76 |
| N205M | | 0.58 |
| N205P | | 0.75 |
| N205R | | 0.54 |
| N205S | | 0.80 |
| N205T | 453 | 0.85 |
| N205V | | 0.49 |
| N205W | | 0.41 |
| V206H | | 0.50 |
| V206I | 454 | 0.94 |
| V206K | 455 | 1.75 |
| V206L | 456 | 1.57 |
| S395T | | 0.39 |
| V206M | | 0.43 |
| V206R | 457 | 1.30 |
| V206S | | 0.72 |
| G072Y | | 0.35 |
| V206T | | 0.59 |
| I208A | | 0.62 |
| I208C | | 0.48 |
| I208K | | 0.91 |
| I208L | | 0.84 |
| I208M | | 0.88 |
| I208Q | | 0.77 |
| I208R | | 1.14 |
| I208S | | 0.62 |
| I208T | | 1.01 |
| I208V | | 1.07 |
| K209A | | 0.53 |
| K209E | | 0.46 |
| K209G | | 0.44 |
| K209N | | 0.50 |
| F398L | | 0.35 |
| S404T | | 0.37 |
| K209R | 458 | 0.68 |
| K209S | | 0.50 |
| K209T | | 0.50 |
| D212N | 459 | 1.52 |
| D212S | 460 | 0.93 |
| D212T | | 0.76 |
| D213A | 461 | 0.85 |
| D213E | | 0.79 |
| D213G | | 0.81 |
| D213H | | 0.75 |
| D213K | | 0.82 |
| D213L | | 0.56 |
| D213M | 462 | 1.56 |
| D213N | 463 | 1.53 |
| D213Q | | 1.04 |
| D213R | | 0.92 |
| D213V | | 0.47 |
| D213W | | 0.49 |
| D213Y | | 0.49 |
| L214Q | | 0.57 |
| S215A | | 0.74 |
| S215D | | 0.62 |
| S215E | | 0.74 |
| S215G | | 0.88 |
| S215H | 464 | 0.91 |
| S215K | | 0.99 |
| S215L | | 0.60 |
| S215M | 465 | 1.77 |
| S215Q | | 0.79 |
| G077K | | 0.32 |
| S215R | | 0.71 |
| S215T | | 0.80 |
| S215V | | 0.69 |
| S215W | | 0.52 |
| W216Y | | 0.48 |
| L217M | | 0.51 |
| W218F | | 0.57 |
| N219A | 466 | 1.29 |
| N219C | | 0.43 |
| N219D | | 0.75 |
| N219E | | 0.95 |
| N219H | | 0.97 |
| N219I | 467 | 0.60 |
| N219K | 468 | 1.45 |
| N219L | | 0.72 |
| N219M | | 1.02 |

TABLE 9-continued

ACTIVE MUTANTS

| mutant | SEQ ID NO | AvgNorm Act. |
|---|---|---|
| I083H | | 0.4 |
| N219R | | 1.10 |
| N219S | 469 | 2.48 |
| N219T | | 0.82 |
| N219W | | 0.48 |
| E220A | | 0.75 |
| E220H | 470 | 1.40 |
| E220I | 471 | 1.34 |
| E220L | 472 | 1.45 |
| E220S | | 0.62 |
| E220T | | 0.91 |
| E220V | 473 | 1.35 |
| S221A | | 0.72 |
| S221C | | 0.59 |
| S221M | | 0.46 |
| S221Q | 474 | 1.37 |
| S221T | | 0.94 |
| S221V | | 1.04 |
| T222D | | 0.43 |
| T222F | | 0.43 |
| T222G | 475 | 0.49 |
| T222K | | 0.75 |
| T222L | | 0.64 |
| T222N | | 0.80 |
| T222R | | 0.75 |
| E220D | | 0.39 |
| T222I | | 0.4 |
| T222S | | 0.63 |
| T222V | | 0.79 |
| L224I | | 0.61 |
| L230I | | 0.87 |
| N231T | | 1.10 |
| T232F | 476 | 0.73 |
| T232S | | 0.76 |
| Q233A | | 0.71 |
| Q233F | | 0.53 |
| Q233G | 477 | 0.46 |
| Q233K | 478 | 1.69 |
| Q233L | | 0.69 |
| Q233R | 479 | 1.50 |
| Q233Y | | 0.50 |
| Q234M | 480 | 1.65 |
| S235A | 481 | 0.47 |
| S235E | | 1.00 |
| S235G | | 0.95 |
| S235H | | 0.44 |
| S235K | | 0.53 |
| S235T | | 0.66 |
| P236A | | 1.07 |
| P236G | | 1.09 |
| P236H | | 0.46 |
| P236K | | 0.71 |
| P236R | 482 | 3.09 |
| Q234L | | 0.40 |
| P236S | | 0.91 |
| V237A | | 0.90 |
| V237E | 484 | 1.93 |
| V237F | | 0.41 |
| A412Q | 751 | 0.35 |
| A413Q | | 0.38 |
| V414L | | 0.36 |
| D418G | | 0.45 |
| V237H | 485 | 0.75 |
| V237L | | 1.12 |
| V237N | | 0.67 |
| L089W | | 0.26 |
| V237Q | 486 | 1.46 |
| V237R | | 0.71 |
| V237S | | 1.03 |
| V237T | 487 | 1.01 |
| V237W | | 0.52 |
| A238D | | 0.75 |
| A238E | 488 | 0.59 |
| A238H | 489 | 0.60 |
| A238K | | 0.60 |
| A238Q | | 1.02 |
| A238R | | 0.49 |
| A238S | 490 | 2.62 |
| A238T | | 0.44 |
| T240K | | 1.13 |
| T240A | 491 | 0.48 |
| T240M | | 0.48 |
| T240P | | 0.56 |
| T240Q | 492 | 0.75 |
| T240R | | 0.91 |
| A239N | | 0.32 |
| T240S | | 0.74 |
| T240V | | 0.77 |
| Y242F | | 1.08 |
| N245H | | 0.50 |
| V247I | 493 | 2.01 |
| V247L | | 0.83 |
| V247M | | 0.52 |
| R248A | 494 | 0.43 |
| R248W | | 0.52 |
| R248Y | | 0.67 |
| I251Y | | 0.37 |
| I251L | | 0.58 |
| I251M | | 0.43 |
| V253I | | 0.76 |
| K255A | | 0.40 |
| K255N | | 0.52 |
| K255Q | | 0.91 |
| K255R | | 0.71 |
| K093P | | 0.38 |
| K255S | | 0.43 |
| I256A | | 0.42 |
| I256H | | 0.51 |
| I256L | | 0.64 |
| I256V | | 0.51 |
| P257A | | 0.82 |
| P257G | 496 | 0.51 |
| P257I | | 1.07 |
| P257K | | 0.92 |
| P257L | | 0.69 |
| P257M | | 0.90 |
| P257N | | 0.69 |
| P257Q | | 0.61 |
| P257R | 498 | 1.38 |
| P257T | 497 | 2.04 |
| P257V | | 0.88 |
| D258H | | 0.84 |
| D258N | 499 | 1.44 |
| D258R | | 0.45 |
| D258S | 500 | 1.44 |
| D258G | | 0.39 |
| D426S | | 0.36 |
| G427I | | 0.54 |
| A259E | | 0.85 |
| A259G | | 0.68 |
| A259I | | 0.46 |
| A259K | | 0.76 |
| A259L | | 0.53 |
| A259N | | 0.49 |
| A259P | 501 | 1.54 |
| A259Q | | 0.70 |
| A259R | | 0.72 |
| A259S | | 0.63 |
| A259T | | 0.51 |
| A259V | | 0.41 |
| A259W | | 0.55 |
| A259Y | | 0.51 |
| K260A | | 0.66 |
| K260D | | 0.41 |
| K260E | | 0.58 |
| K260H | | 0.87 |
| K260L | | 0.60 |

TABLE 9-continued

ACTIVE MUTANTS

| mutant | SEQ ID NO | AvgNorm Act. |
|---|---|---|
| E249V | 495 | |
| K260M | 502 | 0.85 |
| K260Q | | 0.58 |
| K260R | | 0.83 |
| K260S | | 0.66 |
| K260G | | 0.37 |
| K260Y | 503 | 1.73 |
| S261A | 504 | 0.74 |
| S261F | | 0.73 |
| S261K | 505 | 2.54 |
| S261M | | 0.56 |
| S261N | 506 | 1.98 |
| S261Q | | 0.76 |
| S261R | | 1.19 |
| S261T | | 0.66 |
| S261V | | 0.48 |
| S261W | | 0.44 |
| L263A | | 0.76 |
| L263K | 507 | 2.73 |
| L263M | | 0.89 |
| L263R | 508 | 1.63 |
| L263T | | 0.49 |
| N104I | | 0.35 |
| L263V | | 0.75 |
| P264A | | 0.43 |
| P264H | | 0.60 |
| V265I | | 0.58 |
| F266Y | | 0.58 |
| A267M | | 0.45 |
| A267T | 509 | 1.34 |
| T269A | 510 | 1.63 |
| T269C | | 0.75 |
| T269D | | 0.76 |
| T269S | | 1.01 |
| R270M | | 0.46 |
| R270N | | 0.52 |
| R270S | | 0.69 |
| I271F | | 0.72 |
| I271G | | 1.29 |
| L105C | | 0.33 |
| I271L | 511 | 10.62 |
| V272E | | 0.39 |
| I271M | 512 | 3.24 |
| I271S | | 0.42 |
| I271V | | 1.05 |
| V272D | 513 | 1.36 |
| V272R | | 0.74 |
| V272S | | 0.96 |
| V272T | 514 | 1.61 |
| F273H | 515 | 1.41 |
| F273T | | 0.48 |
| F273Y | 516 | 0.90 |
| T274A | | 0.51 |
| T274F | 517 | 1.28 |
| T274S | | 0.62 |
| Q276C | | 0.88 |
| Q276D | 518 | 1.69 |
| Q276E | | 1.05 |
| Q276H | 519 | 1.20 |
| Q276I | | 0.51 |
| Q276L | | 0.48 |
| W119Q | | 0.72 |
| Q276M | 520 | 1.14 |
| Q276R | 521 | 1.30 |
| Q276S | 522 | 1.63 |
| Q276Y | 523 | 1.94 |
| V277A | 524 | 0.65 |
| V277C | | 0.41 |
| V277D | | 0.79 |
| V277E | 525 | 1.02 |
| V277G | | 1.18 |
| V277H | 526 | 1.09 |
| V277K | 527 | 1.51 |
| V277M | 528 | 0.94 |
| V277N | 529 | 1.15 |
| V277Q | 530 | 0.82 |
| V277R | 531 | 1.63 |
| V277S | 532 | 0.83 |
| K124H | | 0.35 |
| V277T | 533 | 1.94 |
| V277Y | | 0.66 |
| L278A | | 1.13 |
| L278E | 534 | 1.03 |
| L278F | 535 | 1.26 |
| L278G | 536 | 1.33 |
| L278H | 537 | 4.50 |
| L278I | | 0.93 |
| L278K | 538 | 1.75 |
| D275V | | 0.4 |
| L278N | 539 | 1.74 |
| L278R | 540 | 5.87 |
| L278S | 541 | 1.67 |
| L278T | 542 | 1.66 |
| L278V | | 0.44 |
| L278Y | 543 | 1.51 |
| K279H | 544 | 0.44 |
| K279Q | | 0.84 |
| K279R | | 1.10 |
| K279T | | 0.86 |
| F280G | | 0.47 |
| F280Q | | 0.43 |
| S282D | | 0.41 |
| S282G | | 0.54 |
| S282M | 545 | 2.64 |
| S282Q | | 0.41 |
| Q283E | | 0.63 |
| Q283P | | 1.18 |
| Q283R | | 0.59 |
| Q283S | 546 | 1.73 |
| Q283T | | 0.65 |
| D284A | | 0.58 |
| D284E | | 1.21 |
| D284G | | 0.60 |
| D284H | | 0.51 |
| D284L | | 0.50 |
| D284M | | 0.56 |
| D284N | | 0.40 |
| D284Q | | 0.95 |
| D284S | | 0.99 |
| E285F | | 0.47 |
| E285G | | 0.52 |
| E285H | 547 | 1.30 |
| E285M | | 0.43 |
| E285N | | 0.40 |
| E285Q | | 0.59 |
| E285Y | | 0.99 |
| L286S | | 0.46 |
| D284T | | 0.39 |
| L286R | | 0.53 |
| V287I | | 0.51 |
| V287T | 548 | 0.50 |
| Y288L | | 0.79 |
| Y288W | | 0.49 |
| T289K | | 0.75 |
| T289S | 549 | 0.48 |
| F290I | | 0.41 |
| F290M | | 1.03 |
| G291Q | | 0.80 |
| G291R | | 0.45 |
| G291S | 550 | 0.41 |
| G291V | 551 | 1.63 |
| E292A | | 0.66 |
| E292C | 552 | 0.71 |
| E292F | 553 | 0.90 |
| E292G | | 0.41 |
| E292H | 554 | 1.26 |
| E442W | | 0.38 |

TABLE 9-continued

ACTIVE MUTANTS

| mutant | SEQ ID NO | AvgNorm Act. |
|---|---|---|
| E292K | 555 | 1.27 |
| E292N |  | 0.99 |
| E292P |  | 1.05 |
| E292R | 556 | 0.42 |
| E292V | 557 | 1.28 |
| E292W |  | 0.83 |
| T293A | 558 | 1.90 |
| T293C | 559 | 1.67 |
| T293D | 560 | 1.46 |
| V137C |  | 0.37 |
| V137S |  | 0.36 |
| V137L |  | 0.21 |
| Q143C |  | 0.28 |
| L144R | 360 | 0.26 |
| K152W | 396 | 0.37 |
| A153S |  | 0.34 |
| K154I |  | 0.38 |
| E156C |  | 0.35 |
| E158G |  | 0.37 |
| K159G |  | 0.38 |
| A160W |  | 0.39 |
| G161V |  | 0.42 |
| D163W |  | 0.38 |
| D163F |  | 0.39 |
| L165C |  | 0.27 |
| V166N |  | 0.47 |
| E167F |  | 0.31 |
| K170A |  | 0.40 |
| K170Q |  | 0.40 |
| K173Q |  | 0.32 |
| L174H |  | 0.38 |
| R176L |  | 0.40 |
| P177V |  | 0.36 |
| L180I |  | 0.38 |
| W181K |  | 0.29 |
| Y183E |  | 0.32 |
| Y184W |  | 0.39 |
| H193R |  | 0.33 |
| H193F |  | 0.38 |
| K195V |  | 0.36 |
| K196N |  | 0.39 |
| K196Y |  | 0.39 |
| P197W |  | 0.39 |
| G198W |  | 0.29 |
| N200T |  | 0.37 |
| F204W |  | 0.39 |
| N205L | 452 | 0.39 |
| N205Y |  | 0.4 |
| V206Q |  | 0.33 |
| K209F |  | 0.4 |
| K209L |  | 0.38 |
| N211L |  | 0.41 |
| N211W |  | 0.51 |
| W218M |  | 0.38 |
| W218V |  | 0.28 |
| T293F | 561 | 1.94 |
| T293G |  | 1.00 |
| T293K | 562 | 1.35 |
| T293L |  | 1.00 |
| T293M | 563 | 2.29 |
| T293P | 564 | 1.64 |
| T293Q | 565 | 1.83 |
| T293S |  | 0.89 |
| T293V | 566 | 2.15 |
| T293Y | 567 | 1.49 |
| V294M |  | 0.41 |
| A298G | 568 | 0.43 |
| A298I |  | 0.41 |
| G300R |  | 0.42 |
| I301A |  | 0.88 |
| I301V |  | 0.88 |
| V287N |  | 0.35 |
| V302W |  | 0.46 |
| V302I |  | 0.45 |
| I303V |  | 0.47 |
| W304G |  | 1.13 |
| W304I |  | 1.17 |
| G305D |  | 1.00 |
| G305E | 569 | 1.62 |
| T306D |  | 0.76 |
| T306E |  | 0.52 |
| T306S |  | 1.02 |
| L307K |  | 0.43 |
| L307N |  | 0.76 |
| L307Q |  | 0.61 |
| L307S |  | 0.86 |
| L307T |  | 1.08 |
| L307V |  | 0.48 |
| L307W |  | 0.64 |
| L307Y |  | 0.60 |
| S308D | 571 | 0.92 |
| S308G | 572 | 1.73 |
| S308H |  | 1.15 |
| S308K | 573 | 1.33 |
| S308N | 574 | 2.33 |
| S308P |  | 0.65 |
| S308R | 575 | 1.34 |
| S308T |  | 0.72 |
| I309D |  | 0.72 |
| I309E | 576 | 1.99 |
| I309G | 577 | 1.44 |
| I303D |  | 0.34 |
| I309H | 578 | 1.30 |
| I309K |  | 0.98 |
| I309L | 579 | 1.72 |
| I309M | 580 | 1.47 |
| I309N | 581 | 3.11 |
| I309Q | 582 | 1.64 |
| I309R | 583 | 2.27 |
| I309S | 584 | 1.16 |
| I309T | 585 | 2.09 |
| I309V | 586 | 0.60 |
| I309W |  | 0.88 |
| M310A | 587 | 1.50 |
| M310G | 588 | 2.73 |
| M310Q | 589 | 0.59 |
| M310R |  | 0.50 |
| M310S | 590 | 1.61 |
| M310V |  | 0.70 |
| R311G |  | 0.53 |
| L307G | 570 | 0.32 |
| R311G |  | 0.54 |
| R311H |  | 0.48 |
| R311K |  | 0.72 |
| R311Q |  | 0.43 |
| R311S |  | 0.84 |
| R311T |  | 0.52 |
| S312G |  | 0.49 |
| S312N |  | 1.26 |
| S312T |  | 0.75 |
| M313A | 591 | 1.34 |
| M313E |  | 0.63 |
| M313G | 592 | 0.56 |
| M313H | 593 | 1.23 |
| M313K | 594 | 2.85 |
| S312L |  | 0.38 |
| M313L |  | 1.05 |
| M313P | 595 | 1.11 |
| M313R | 596 | 2.30 |
| M313S |  | 0.88 |
| M313T | 597 | 0.67 |
| M313V |  | 0.99 |
| M313Y | 598 | 1.12 |
| K314A |  | 0.82 |
| K314D |  | 0.53 |
| K314H |  | 1.10 |
| K314I |  | 0.54 |
| K314N |  | 0.57 |

TABLE 9-continued

ACTIVE MUTANTS

| mutant | SEQ ID NO | AvgNorm Act. |
|---|---|---|
| K314Q | | 0.62 |
| K314R | | 0.95 |
| K314S | 599 | 0.61 |
| K314T | | 0.61 |
| K314Y | 600 | 0.45 |
| S315A | 601 | 0.85 |
| S315E | | 0.41 |
| S315G | | 0.72 |
| S315H | 602 | 2.04 |
| S315K | | 0.62 |
| S315L | | 0.42 |
| S315M | | 0.63 |
| S315R | | 1.04 |
| S315T | | 0.97 |
| S315Y | 603 | 0.50 |
| C316D | | 0.41 |
| L317A | 604 | 1.27 |
| L317D | | 0.61 |
| L317H | | 1.05 |
| L317I | 605 | 1.76 |
| L317K | 606 | 5.11 |
| L317M | | 1.20 |
| L317N | 607 | 0.73 |
| L317Q | 608 | 1.67 |
| L317R | 609 | 2.41 |
| L317S | 610 | 1.03 |
| L317T | 611 | 0.93 |
| L317W | 612 | 0.84 |
| L318D | 614 | 0.46 |
| L318F | | 0.51 |
| L318G | | 0.49 |
| L318H | 615 | 0.45 |
| L318I | | 0.70 |
| L318K | 616 | 1.36 |
| L318M | 613 | 1.68 |
| L318N | | 0.52 |
| L318Q | | 0.71 |
| L318R | 617 | 1.34 |
| L318S | | 0.71 |
| L318T | | 0.63 |
| D320E | | 0.78 |
| D320G | | 0.83 |
| D320H | 618 | 1.75 |
| D320I | | 1.00 |
| D320K | 619 | 6.42 |
| D320M | | 0.79 |
| D320N | | 0.52 |
| D320R | 620 | 3.19 |
| D320S | | 1.19 |
| D320W | | 0.40 |
| D320V | | 0.35 |
| D320Y | | 0.86 |
| N321A | | 1.01 |
| N321D | | 1.25 |
| N321H | | 0.92 |
| N321K | | 1.29 |
| N321R | 621 | 1.23 |
| N321S | 622 | 1.26 |
| N321T | | 0.64 |
| N321Y | | 0.40 |
| M323F | | 0.64 |
| M323I | | 0.55 |
| M323L | | 0.55 |
| E324A | | 0.59 |
| E324D | | 1.15 |
| E324H | | 0.79 |
| E324M | | 0.50 |
| E324N | 623 | 1.01 |
| E324R | 624 | 2.28 |
| E324S | | 0.62 |
| T325A | 625 | 1.87 |
| T325D | 626 | 1.78 |
| T325E | 627 | 4.03 |
| T325G | 628 | 4.21 |
| T325H | 629 | 3.45 |
| T325K | 630 | 4.37 |
| T325M | 631 | 2.11 |
| T325N | 632 | 4.64 |
| T325Q | 633 | 5.08 |
| T325S | 634 | 3.19 |
| T325V | 635 | 1.24 |
| T325W | | 0.62 |
| I326K | | 0.95 |
| I326L | 636 | 1.50 |
| I326V | 637 | 6.29 |
| I326Y | | 0.77 |
| L327M | | 0.52 |
| N328A | | 0.67 |
| N328C | 638 | 1.25 |
| N328G | 639 | 0.56 |
| N328H | | 0.88 |
| N328I | 642 | 1.85 |
| N328K | 640 | 2.12 |
| N328L | 641 | 2.01 |
| N328Q | | 1.13 |
| N328R | | 0.68 |
| N328S | 643 | 2.22 |
| N328T | | 0.59 |
| N328V | | 1.16 |
| N328Y | 644 | 1.66 |
| I331V | | 0.94 |
| N328W | | 0.33 |
| V334T | | 0.39 |
| V334P | | 0.46 |
| T335S | 645 | 0.47 |
| A338Q | | 0.63 |
| K339M | | 0.61 |
| S342A | | 0.68 |
| Q343T | | 0.49 |
| Q343V | | 0.51 |
| Q347A | 646 | 0.78 |
| Q347E | | 0.78 |
| Q347G | 647 | 2.68 |
| Q347M | | 0.61 |
| Q347R | | 0.55 |
| Q347S | 648 | 2.38 |
| E348D | | 0.67 |
| E348G | | 0.55 |
| E348S | | 0.44 |
| Q349A | | 0.47 |
| Q349E | | 0.83 |
| Q349K | | 0.93 |
| Q349M | 649 | 0.70 |
| Q349N | | 0.44 |
| M035V | 146 | 0.37 |
| Q349R | 650 | 0.73 |
| Q349T | | 0.49 |
| V351A | | 1.14 |
| V351S | 651 | 0.92 |
| I353T | | 0.42 |
| I353V | 652 | 1.61 |
| N356A | | 0.41 |
| N356D | | 0.79 |
| N356H | 653 | 0.82 |
| N356S | 654 | 0.46 |
| W357A | | 0.80 |
| W357C | | 0.67 |
| L037W | | 0.36 |
| W357S | | 0.41 |
| W357T | | 0.62 |
| N358C | | 0.66 |
| N358G | | 0.41 |
| N358T | | 0.58 |
| V351I | | 0.36 |
| N358L | | 0.38 |
| S359D | | 0.45 |
| S359E | 655 | 1.05 |

TABLE 9-continued

ACTIVE MUTANTS

| mutant | SEQ ID NO | AvgNorm Act. |
|---|---|---|
| S359H | 656 | 0.44 |
| S359K |  | 0.66 |
| S359M |  | 0.63 |
| S359T | 657 | 2.11 |
| S359V |  | 0.65 |
| S360T |  | 0.50 |
| P367A | 658 | 0.55 |
| P367C |  | 0.83 |
| P367G | 659 | 0.47 |
| P367K | 660 | 0.57 |
| P367R |  | 0.46 |
| P367S | 661 | 0.52 |
| D368A | 662 | 1.34 |
| D368E | 663 | 1.28 |
| D368G |  | 0.49 |
| D368H |  | 0.96 |
| D368K | 664 | 1.31 |
| D368L | 665 | 0.64 |
| D368M | 666 | 0.78 |
| D368R | 667 | 1.31 |
| D368S |  | 0.93 |
| D368T | 668 | 0.80 |
| D361H |  | 0.37 |
| D368V |  | 0.41 |
| N369H | 669 | 1.33 |
| N369R | 670 | 0.55 |
| N369S |  | 0.54 |
| A371E |  | 1.05 |
| A371F | 671 | 0.52 |
| A371H | 672 | 1.20 |
| A371I |  | 0.50 |
| A371K | 673 | 1.76 |
| L374W |  | 0.34 |
| A371L | 674 | 0.57 |
| A371M |  | 0.57 |
| A371R | 675 | 1.51 |
| A371S | 676 | 1.45 |
| A371V |  | 0.94 |
| Q373A |  | 0.65 |
| Q373E |  | 0.81 |
| Q373F |  | 0.62 |
| Q373K |  | 0.73 |
| Q373L |  | 0.84 |
| Q373M | 677 | 1.43 |
| Q373R |  | 0.68 |
| Q373S |  | 0.87 |
| Q373V |  | 1.05 |
| L374A |  | 0.60 |
| L374H | 678 | 1.42 |
| L374I |  | 0.80 |
| L374M |  | 1.11 |
| L374N |  | 0.43 |
| L374P | 679 | 0.43 |
| L374R |  | 0.83 |
| L374S |  | 0.58 |
| L374T |  | 0.47 |
| L374V |  | 0.56 |
| L374Y |  | 0.66 |
| E375A | 680 | 0.42 |
| E375G | 681 | 0.90 |
| E375K | 682 | 1.49 |
| E375L |  | 0.46 |
| E375M |  | 0.54 |
| E375N |  | 0.81 |
| E375R | 683 | 0.43 |
| E375S |  | 0.77 |
| E375T |  | 1.17 |
| K376A |  | 0.95 |
| K376D | 684 | 0.78 |
| K376E | 685 | 0.88 |
| K376M |  | 0.46 |
| K376Q | 686 | 0.69 |
| K376R | 687 | 0.67 |
| K376S |  | 0.80 |
| K376T | 688 | 0.53 |
| K376V | 689 | 0.58 |
| K376Y | 690 | 0.42 |
| G377D | 691 | 1.35 |
| G377E | 692 | 0.59 |
| G377H | 693 | 1.49 |
| G377K | 694 | 1.50 |
| G377P | 695 | 2.30 |
| G377R | 696 | 1.28 |
| G377S | 697 | 1.80 |
| Q051R |  | 0.36 |
| G377T | 698 | 3.83 |
| G378K |  | 1.22 |
| G378N |  | 0.64 |
| G378R |  | 1.03 |
| K379G |  | 0.52 |
| K379H |  | 0.57 |
| K379R |  | 0.74 |
| K379S |  | 0.46 |
| K379T |  | 0.4 |
| M035Q | 145 | 0.37 |
| F380I |  | 0.56 |
| F380L |  | 0.67 |
| F380P |  | 0.47 |
| F380W | 699 | 2.15 |
| F380Y | 700 | 1.50 |
| T381H |  | 0.48 |
| T381K |  | 1.06 |
| T381N |  | 0.51 |
| T381Q |  | 0.84 |
| T381R |  | 0.87 |
| T381S | 701 | 0.87 |
| T381V |  | 0.89 |
| R383A |  | 0.51 |
| R383E |  | 0.51 |
| R383H |  | 0.71 |
| R383I | 702 | 0.71 |
| R383K | 703 | 1.30 |
| R383L | 704 | 1.31 |
| R383M |  | 0.61 |
| R383N |  | 0.77 |
| T381E |  | 0.35 |
| R383S | 705 | 0.87 |
| R383T |  | 0.98 |
| R383V |  | 1.05 |
| K385A | 706 | 1.12 |
| K385G |  | 0.62 |
| K385H |  | 0.50 |
| K385N |  | 0.41 |
| K385Q | 707 | 0.73 |
| K385R |  | 0.94 |
| K385S |  | 1.05 |
| K385T |  | 0.46 |
| K385V | 708 | 0.43 |
| T387S |  | 0.93 |
| L388F |  | 0.92 |
| L388H |  | 0.47 |
| L388I |  | 0.98 |
| L388M |  | 0.79 |
| L388R |  | 0.60 |
| L388T |  | 0.51 |
| L388V |  | 0.78 |
| L388W |  | 0.77 |
| L388Y |  | 1.18 |
| E392W |  | 0.31 |
| E389A | 709 | 1.14 |
| E389G | 710 | 0.91 |
| E389H |  | 1.17 |
| E389K | 712 | 1.91 |
| E389L | 711 | 0.65 |
| E389M |  | 0.60 |
| E389P |  | 0.75 |
| E389Q | 713 | 0.69 |
| E389R |  | 0.94 |

TABLE 9-continued

ACTIVE MUTANTS

| mutant | SEQ ID NO | AvgNorm Act. |
|---|---|---|
| E389S | 714 | 1.08 |
| E389T | | 0.70 |
| E389Y | | 0.77 |
| L391C | | 0.90 |
| E392A | 715 | 0.58 |
| E392F | 716 | 0.54 |
| E392G | | 1.00 |
| E392K | | 0.66 |
| E392L | | 0.80 |
| E392M | 717 | 1.54 |
| E392Q | 718 | 1.01 |
| E392R | 719 | 0.66 |
| E392S | | 0.52 |
| E392T | | 0.72 |
| E392V | 720 | 1.27 |
| E392Y | | 0.92 |
| Q393A | | 1.26 |
| Q393D | | 0.45 |
| Q393F | 721 | 1.23 |
| Q393H | | 1.05 |
| Q393K | | 0.80 |
| Q393L | | 0.91 |
| Q393M | 722 | 0.80 |
| Q393N | | 0.72 |
| Q393R | | 0.74 |
| Q393S | | 1.15 |
| Q393T | | 0.41 |
| F394L | | 0.56 |
| F394W | | 0.41 |
| S395A | 723 | 1.10 |
| S395G | | 0.77 |
| S395H | 724 | 0.56 |
| S395K | | 0.96 |
| S395R | 725 | 1.98 |
| E396A | 726 | 0.52 |
| E396D | | 0.64 |
| E396H | 727 | 0.47 |
| E396Q | 728 | 0.73 |
| E396R | | 0.61 |
| E396S | 729 | 0.61 |
| E396T | | 0.89 |
| E396L | | 0.39 |
| Y399A | | 1.01 |
| Y399C | | 0.46 |
| Y399E | | 1.49 |
| S407L | | 0.4 |
| Y399K | 730 | 1.94 |
| Y399M | 731 | 2.70 |
| Y399N | | 0.52 |
| Y399Q | | 1.18 |
| Y399R | | 1.20 |
| Y399S | | 1.01 |
| Y399T | 732 | 2.40 |
| Y399V | 733 | 1.44 |
| Y399W | 734 | 1.92 |
| S401A | 735 | 0.82 |
| S401E | 736 | 0.46 |
| S401N | | 0.42 |
| Y403F | | 0.62 |
| S404A | 737 | 0.63 |
| S404P | | 0.64 |
| S401G | | 0.38 |
| T405F | | 0.36 |
| T405A | | 0.56 |
| T405G | 738 | 2.32 |
| T405K | | 0.74 |
| T405M | | 0.48 |
| T405P | | 0.64 |
| T405Q | | 0.75 |
| T405R | | 0.60 |
| T405S | | 0.94 |
| T405W | | 0.73 |
| T405Y | | 0.44 |
| L406A | | 0.70 |
| L406C | | 0.98 |
| L406E | | 0.73 |
| L406F | 739 | 1.42 |
| L406G | | 1.00 |
| L406I | | 0.61 |
| L406N | 740 | 0.76 |
| L406Q | | 0.93 |
| L406S | | 0.47 |
| L406T | | 0.83 |
| L406V | | 0.87 |
| L406Y | | 0.74 |
| S407A | 741 | 1.16 |
| S407D | 742 | 1.52 |
| S407E | 743 | 1.38 |
| S407F | 744 | 1.42 |
| S407G | | 0.75 |
| S407H | 745 | 1.34 |
| S407M | | 0.74 |
| K411H | | 0.33 |
| S407N | | 0.72 |
| S407P | 747 | 0.94 |
| S407Q | 746 | 1.71 |
| S407R | | 1.04 |
| S407V | | 0.56 |
| S407W | | 0.41 |
| K409A | 748 | 2.18 |
| K409D | | 0.65 |
| K409E | | 0.62 |
| K409G | | 0.50 |
| K409H | | 0.64 |
| K409I | | 0.51 |
| K409P | | 0.48 |
| K409Q | 749 | 3.33 |
| K409R | | 0.84 |
| K409S | | 0.72 |
| I083K | | 0.30 |
| K409T | | 0.63 |
| K409V | | 0.48 |
| A412Y | | 0.66 |
| E410D | | 0.47 |
| E410K | | 0.70 |
| E410M | | 0.42 |
| E410N | | 0.67 |
| E410P | | 0.73 |
| E410Q | | 0.85 |
| E410R | | 0.61 |
| E410S | | 0.81 |
| E410T | 750 | 1.54 |
| E410V | | 0.65 |
| E410Y | | 0.62 |
| K411A | | 0.48 |
| K411N | | 1.02 |
| K411P | | 0.42 |
| K411R | | 0.97 |
| K411S | | 1.21 |
| K411T | | 0.63 |
| K411V | | 0.99 |
| A412D | | 0.74 |
| A412G | | 0.80 |
| A412I | | 0.81 |
| E220M | | 0.36 |
| P226W | | 0.51 |
| A412L | | 0.65 |
| A412N | | 0.86 |
| A412P | | 0.77 |
| A412R | 752 | 0.66 |
| A412S | | 0.86 |
| A412V | 753 | 0.53 |
| A412W | | 0.54 |
| D413E | | 0.52 |
| D413K | | 0.42 |
| D413N | | 0.94 |
| D413R | | 0.50 |
| D413T | | 0.41 |

TABLE 9-continued

ACTIVE MUTANTS

| mutant | SEQ ID NO | AvgNorm Act. |
|---|---|---|
| V414I | | 1.12 |
| V414M | | 0.53 |
| K415G | | 0.40 |
| K415S | | 0.42 |
| K415W | | 0.42 |
| D416F | | 0.41 |
| D416G | | 0.67 |
| D416H | | 0.57 |
| D416I | | 0.63 |
| D416K | | 0.76 |
| D416L | 754 | 0.75 |
| D416N | | 0.73 |
| D416Q | | 0.83 |
| D416R | | 0.46 |
| V237C | 483 | 0.35 |
| D416T | | 0.85 |
| D416V | | 0.59 |
| D416Y | | 0.40 |
| T417I | | 1.22 |
| D413A | | 0.38 |
| D413S | | 0.39 |
| K415Y | | 0.39 |
| D418A | | 0.92 |
| D418E | 755 | 1.31 |
| D418F | | 0.81 |
| L089P | | 0.38 |
| D418G | | 0.45 |
| D418I | | 0.99 |
| D418L | 756 | 1.28 |
| D418M | | 1.09 |
| D418N | | 0.91 |
| D418P | 757 | 2.11 |
| D418Q | | 1.05 |
| D418R | 758 | 1.18 |
| D418S | | 0.78 |
| D418V | 759 | 1.43 |
| D418Y | | 0.97 |
| A419E | | 0.45 |
| A419F | 760 | 2.17 |
| A419G | | 0.42 |
| A419H | 761 | 1.21 |
| A419I | 762 | 1.64 |
| A419K | 763 | 1.88 |
| A419L | | 0.56 |
| A419N | | 0.53 |
| V421I | | 0.39 |
| A419R | 764 | 1.81 |
| A419S | 765 | 2.65 |
| A419W | | 0.69 |
| A419Y | 766 | 1.44 |
| V420I | | 1.04 |
| V420P | | 0.48 |
| D421A | 767 | 1.28 |
| D421E | | 0.81 |
| D421G | | 0.62 |
| D421H | 768 | 1.98 |
| K255G | | 0.39 |
| D421K | 769 | 2.42 |
| D421L | | 0.73 |
| D421M | | 0.94 |
| D421N | 770 | 1.89 |
| D421Q | 771 | 1.54 |
| D421R | 772 | 2.21 |
| D421S | 773 | 2.12 |
| K094C | | 0.33 |
| D421T | | 0.80 |
| D421Y | | 0.66 |
| V422I | | 0.42 |
| V422T | | 0.49 |
| A425G | 774 | 1.20 |
| A425I | | 0.44 |
| A425K | 775 | 1.75 |
| A425M | | 0.70 |
| A425N | | 0.46 |
| A425R | | 0.49 |
| A425S | | 0.47 |
| D426E | | 0.62 |
| D426G | | 0.85 |
| D426N | | 0.61 |
| D426P | | 1.03 |
| D426Q | | 0.42 |
| D426Y | | 0.43 |
| G427K | | 0.52 |
| G427S | | 0.42 |
| V428L | 778 | 1.25 |
| A425Y | | 0.39 |
| G427T | 777 | 0.35 |
| G427Q | 776 | 0.39 |
| V428M | | 0.42 |
| V428P | | 0.82 |
| V428T | | 0.62 |
| D431A | 779 | 2.42 |
| D431E | 781 | 1.27 |
| D431G | 780 | 0.55 |
| D431H | 782 | 3.13 |
| D431I | | 1.05 |
| D431K | 783 | 1.83 |
| D431L | 784 | 0.62 |
| D431N | 785 | 1.30 |
| D431Q | 786 | 2.16 |
| D431R | 787 | 2.20 |
| D431S | 788 | 1.91 |
| D431V | 789 | 1.52 |
| D431W | | 0.56 |
| D431Y | | 0.85 |
| A432E | | 0.60 |
| A432G | | 0.52 |
| A432H | | 0.34 |
| A432N | | 0.51 |
| A432S | | 0.61 |
| A432V | | 0.56 |
| F433A | 790 | 0.97 |
| R270T | | 0.40 |
| F433C | | 0.69 |
| F433D | | 0.95 |
| F433E | | 0.82 |
| F433G | | 0.54 |
| F433H | 791 | 0.83 |
| F433I | 792 | 1.06 |
| F433K | 793 | 1.36 |
| F433L | 794 | 1.87 |
| F433P | | 0.95 |
| F433R | 795 | 1.63 |
| F433S | | 0.86 |
| F433T | 796 | 1.86 |
| F433V | 797 | 1.63 |
| F433W | 798 | 1.28 |
| L434F | | 0.41 |
| L434G | | 0.47 |
| L263H | | 0.36 |
| L434I | | 0.89 |
| L434M | | 0.60 |
| L434V | | 0.46 |
| K435A | | 1.08 |
| K435C | | 0.53 |
| K435E | | 0.78 |
| K435G | | 0.64 |
| K435H | | 1.05 |
| K435R | | 1.01 |
| K435S | | 1.03 |
| K435T | | 0.73 |
| K435V | | 0.44 |
| K435Y | | 0.50 |
| P436D | | 1.19 |
| P436E | | 0.74 |
| P436G | | 1.19 |
| L105H | | 0.36 |
| P436H | | 0.72 |

TABLE 9-continued

ACTIVE MUTANTS

| mutant | SEQ ID NO | AvgNorm Act. |
|---|---|---|
| V272M | | 0.31 |
| P436I | | 0.84 |
| P436K | 799 | 2.05 |
| P436L | | 0.63 |
| P436M | | 0.61 |
| P436Q | | 0.86 |
| P436R | | 1.00 |
| P436S | | 0.92 |
| P436T | | 0.59 |
| P436W | | 0.43 |
| P436Y | | 0.49 |
| P437A | | 0.56 |
| P437D | | 0.62 |
| P437G | | 0.50 |
| P437H | | 1.11 |
| P437I | 800 | 2.46 |
| P437K | | 0.83 |
| P437L | | 0.51 |
| P437M | 801 | 2.55 |
| P437Q | | 0.96 |
| D275L | | 0.24 |
| P437R | | 0.85 |
| P437S | | 0.57 |
| P437Y | | 0.42 |
| M438A | 802 | 0.75 |
| M438C | | 0.63 |
| M438D | 803 | 0.87 |
| M438E | 804 | 0.72 |
| M438G | | 0.83 |
| M438L | 805 | 0.86 |
| M438N | 806 | 1.08 |
| M438P | | 0.81 |
| M438Q | | 0.85 |
| M438R | | 0.99 |
| M438S | | 0.83 |
| M438T | 807 | 3.99 |
| M438V | | 0.85 |
| P125A | | 0.36 |
| M438W | | 0.57 |
| E439A | 808 | 1.20 |
| E439C | 809 | 0.58 |
| E439F | | 1.00 |
| E439G | | 1.22 |
| E439H | | 0.74 |
| E439K | 810 | 1.20 |
| E439L | | 0.88 |
| E439P | 811 | 1.16 |
| Q276G | | 0.36 |
| E439Q | 812 | 1.32 |
| E439S | | 1.02 |
| E439T | 813 | 1.15 |
| E439V | 814 | 1.57 |
| E439W | | 0.62 |
| T440A | | 1.22 |
| T440D | 815 | 1.03 |
| T440E | | 1.00 |
| T440F | | 0.85 |
| T440G | | 0.86 |
| T440H | 816 | 3.00 |
| T440I | | 1.04 |
| T440L | | 0.97 |
| T440M | 817 | 1.08 |
| T440P | 818 | 0.88 |
| T440R | 819 | 1.77 |
| T440S | 820 | 1.17 |
| T440V | | 1.02 |
| T440Y | | 1.11 |
| E441A | 821 | 1.47 |
| E441D | | 0.67 |
| E441F | 822 | 3.91 |
| E441G | | 0.87 |
| E441H | | 0.65 |
| E441K | | 0.80 |
| E441L | | 0.82 |
| E441N | | 0.82 |
| E441Q | | 0.81 |
| E441S | | 0.79 |
| E441T | | 0.66 |
| E441V | | 0.54 |
| E441Y | | 0.51 |
| E442C | 823 | 1.38 |
| E442G | 824 | 0.51 |
| E442H | | 0.76 |
| E442K | | 0.73 |
| E442P | | 0.91 |
| E442Q | | 0.74 |
| D284Y | | 0.37 |
| L286W | | 0.38 |
| E442R | 825 | 3.94 |
| E442T | | 0.61 |
| E442V | | 0.65 |
| E442Y | | 0.60 |
| P443A | 826 | 1.63 |
| P443E | 827 | 1.07 |
| P443F | 828 | 0.70 |
| P443G | 829 | 1.12 |
| P443H | | 1.08 |
| P443L | | 1.19 |
| P443M | 830 | 1.99 |
| P443N | 831 | 1.25 |
| P443Q | | 0.96 |
| P443R | | 1.04 |
| P443S | | 0.99 |
| P443T | | 0.87 |
| P443W | | 0.64 |
| Q444M | | 0.37 |
| Q444D | | 0.97 |
| Q444E | 832 | 1.19 |
| Q444F | | 0.66 |
| Q444G | | 0.93 |
| Q444H | 833 | 0.97 |
| Q444I | | 0.58 |
| Q444K | | 1.03 |
| Q444N | | 1.01 |
| Q444R | | 0.85 |
| Q444V | 834 | 1.12 |
| Q444W | | 0.64 |
| Q444Y | | 0.67 |
| I445A | | 0.97 |
| I445G | | 0.98 |
| I445H | 835 | 1.35 |
| I445L | | 1.06 |
| I445M | 836 | 1.57 |
| I445N | 837 | 1.24 |
| I445P | 838 | 1.67 |
| I445Q | 839 | 1.26 |
| I445R | | 1.08 |
| I445S | 840 | 1.21 |
| I445T | 841 | 1.38 |
| I445V | 842 | 1.25 |
| I445W | 843 | 0.69 |
| I445Y | | 0.53 |
| F446A | 844 | 1.58 |
| F446C | | 0.75 |
| F446D | | 1.18 |
| F446E | | 1.10 |
| F446G | | 1.12 |
| F446H | | 1.28 |
| F446I | | 1.06 |
| F446K | | 0.94 |
| F446L | | 0.93 |
| F446M | 845 | 1.31 |
| F446Q | | 0.72 |
| F446R | | 0.89 |
| F446T | | 0.89 |
| F446V | | 0.91 |
| F446W | 846 | 1.40 |
| Y447D | 847 | 3.25 |

TABLE 9-continued

ACTIVE MUTANTS

| mutant | SEQ ID NO | AvgNorm Act. |
|---|---|---|
| Y447E | 848 | 1.36 |
| Y447F |  | 1.41 |
| Y447G | 849 | 0.92 |
| Y447I | 850 | 1.36 |
| Y447L |  | 1.09 |
| Y447M |  | 0.90 |
| Y447N | 851 | 1.58 |
| Y447P | 852 | 1.46 |
| Y447Q | 853 | 2.37 |
| Y447R |  | 1.12 |
| Y447T | 854 | 1.90 |
| Y447V | 855 | 1.38 |
| Y447W |  | 1.07 |

2. Inactive Mutants

The other mutants that exhibited less than 20% hyaluronidase activity of wildtype PH20, in at least one of the duplicates, were rescreened to confirm that the dead mutants are inactive. To confirm the inactive mutants, the hyaluronidase activity assay described in Example 3 was modified to incorporate an overnight 37° C. substrate-sample incubation step prior to measurement of enzymatic activity. The modified assay is intended to detect PH20 activities below 0.2 U/mL.

The preparation of the bHA coated plates and blocking of the plates prior to addition of the transfected variant supernatants or wildtype PH20 was the same as described in Example 3. The assay was modified as follows. First, transfected variant supernatants or wildtype PH20 not containing a mutation generated as described in Example 2 were diluted in duplicate 1:25 in assay diluent. For the standard curve, 1:3 serial dilutions of rHuPH20 (generated as described in Example 1) were made in assay diluent in duplicate starting from 0.1 U/mL down to 0.00014 U/mL. A blank well also was included. Then, 100 µl of the diluted samples or standard were added to pre-designated wells of the bHA-coated and blocked plate and allowed to incubate at 37° C. overnight. After the incubation, the plates were washed and binding to bHA detected as described above in Example 3. Optical density was measured at 450 nm within 30 minutes of adding the stop solution.

The identified reconfirmed inactive mutants are set forth in Table 10. The Table sets forth the amino acid replacement compared to the sequence of amino acids of PH20 set forth in SEQ ID NO:3.

TABLE 10

Inactive Mutants

| | | | | | | | |
|---|---|---|---|---|---|---|---|
| N002H | R060V | R121W | C189P | P236I | V287N | L336W | G377V |
| N002K | R060Y | R121Y | C189R | P236L | V287P | L336Y | G378D |
| N002W | L061A | N122A | C189S | P236N | V287Q | A337C | G378E |
| N002Y | L061E | N122C | C189T | P236Q | V287R | A337F | G378F |
| F003A | L061F | N122E | C189V | P236T | V287S | A337G | G378I |
| F003G | L061G | N122F | C189W | P236Y | Y288D | A337I | G378L |
| F003K | L061H | N122I | C189Y | A238F | Y288E | A337K | G378M |
| F003P | L061N | N122K | Y190C | A238G | Y288F | A337L | G378Q |
| F003T | L061P | N122Q | Y190E | A238L | Y288G | A337M | G378T |
| F003V | L061Q | N122R | Y190F | A238P | Y288H | A337R | G378W |
| R004D | L061R | N122S | Y190G | A238V | Y288I | A337T | G378Y |
| R004E | L061T | N122T | Y190H | A238W | Y288K | A337W | K379A |
| R004F | L061W | N122V | Y190K | A238Y | Y288P | A338C | K379C |
| R004G | L061Y | W123A | Y190L | A239C | Y288R | A338D | K379E |
| R004L | G062A | W123C | Y190N | A239F | Y288T | A338E | K379F |
| R004P | G062C | W123D | Y190Q | A239G | T289A | A338F | K379I |
| R004W | G062D | W123E | Y190R | A239H | T289C | A338G | K379L |
| R004Y | G062F | W123H | Y190S | A239I | T289E | A338H | K379M |
| A005D | G062I | W123L | Y190T | A239L | T289G | A338I | K379W |
| A005G | G062K | W123M | Y190V | A239P | T289H | A338K | F380C |
| A005I | G062L | W123P | Y190W | A239R | T289L | A338L | F380D |
| A005L | G062M | W123Q | N191A | A239S | T289P | A338P | F380E |
| A005M | G062P | W123R | N191E | A239T | T289Q | A338R | F380G |
| A005N | G062Q | W123S | N191F | A239V | T289R | A338T | F380Q |
| A005P | G062R | W123T | N191G | A239W | T289S | A338V | F380R |
| A005Q | G062S | W123V | N191K | A239Y | T289Y | K339D | F380S |
| A005R | G062T | W123Y | N191L | T240E | F290D | K339E | T381G |
| A005T | G062V | K124C | N191M | T240F | F290Q | K339F | T381L |
| A005V | G062Y | K124D | N191P | T240G | F290Y | K339G | T381P |
| A005W | Y063C | K124E | N191Q | T240N | G291A | K339H | T381W |
| A005Y | Y063G | K124F | N191R | T240W | G291C | K339L | T381Y |
| P006E | Y063P | K124N | N191S | T240Y | G291D | K339P | V382E |
| P006F | Y064A | P125C | N191T | L241A | G291E | K339S | V382G |
| P006T | Y064C | P125D | N191V | L241C | G291F | K339T | V382H |
| P006V | Y064D | P125G | N191W | L241D | G291M | K339W | V382K |
| P006Y | Y064E | P125L | N191Y | L241E | G291N | K339Y | V382L |
| P007C | Y064F | P125N | H192C | L241G | G291T | M340A | V382M |
| P007D | Y064G | P125W | H192F | L241I | G291W | M340C | V382N |
| P007F | Y064H | K126F | H192G | L241P | G291Y | M340D | V382P |
| P007G | Y064I | K126H | H192I | L241R | E292I | M340E | V382Q |
| P007H | Y064K | K126I | H192L | L241S | E292L | M340F | V382R |
| P007I | Y064L | K126L | H192M | L241T | E292T | M340G | V382S |
| P007K | Y064P | K126N | H192N | L241V | T293E | M340H | V382T |
| P007L | Y064Q | K126P | H192P | L241W | T293N | M340K | V382W |
| P007Q | Y064R | K126Y | H192Q | Y242A | V294A | M340K | V382Y |
| P007R | Y064S | D127K | H192R | Y242C | V294E | M340K | R383G |

TABLE 10-continued

Inactive Mutants

| | | | | | | | |
|---|---|---|---|---|---|---|---|
| P007S | Y064T | V128E | H192V | Y242D | V294G | M340P | R383P |
| P007T | Y064V | V128P | H192W | Y242G | V294H | M340R | G384C |
| P007W | Y064W | Y129A | H193A | Y242I | V294K | M340S | G384F |
| P007Y | P065A | Y129C | H193D | Y242L | V294L | M340T | G384M |
| V008D | P065C | Y129D | H193K | Y242M | V294N | M340V | G384Q |
| V008E | P065D | Y129E | H193L | Y242P | V294P | M340W | G384S |
| V008G | P065G | Y129G | H193M | Y242R | V294Q | C341A | G384T |
| V008H | P065H | Y129H | H193P | Y242S | V294R | C341E | K385C |
| V008N | P065I | Y129L | H193V | Y242T | V294S | C341G | K385L |
| V008R | P065K | Y129P | Y194A | Y242V | V294T | C341H | K385M |
| V008S | P065N | Y129Q | Y194C | Y242W | V294W | C341K | K385P |
| V008W | P065R | Y129S | Y194I | V243C | A295C | C341L | K385W |
| I009C | P065S | Y129T | Y194L | V243D | A295G | C341M | K385Y |
| I009D | P065T | Y129V | Y194P | V243F | A295H | C341N | P386A |
| I009E | P065V | Y129W | Y194S | V243G | A295I | C341Q | P386C |
| I009G | P065W | K130C | Y194T | V243H | A295L | C341R | P386F |
| I009N | P065Y | K130D | Y194V | V243L | A295N | C341S | P386G |
| I009P | Y066A | K130G | K195S | V243M | A295P | C341T | P386H |
| P010F | Y066C | K130H | P197C | V243P | A295T | C341V | P386I |
| P010I | Y066D | K130L | G198V | V243Q | A295V | C341Y | P386L |
| P010L | Y066E | K130N | G198W | V243R | A295Y | S342D | P386M |
| P010M | Y066G | K130S | Y199E | V243S | L296C | S342E | P386N |
| P010Y | Y066I | K130T | Y199G | V243W | L296F | S342F | P386Q |
| N011A | Y066K | K130W | Y199H | V243Y | L296G | S342H | P386R |
| N011C | Y066L | K130Y | Y199I | R244A | L296I | S342K | P386S |
| N011F | Y066N | N131P | R244D | L296K | S342L | P386T |
| N011I | Y066P | R132P | Y199K | R244G | L296M | S342M | P386V |
| N011L | Y066S | S133D | Y199L | R244I | L296Q | S342P | P386Y |
| N011P | Y066T | S133E | Y199P | R244V | L296R | S342Q | T387C |
| N011T | Y066V | S133F | Y199R | R244Y | L296S | S342R | T387E |
| N011W | I067D | S133G | Y199S | N245A | L296T | S342T | T387F |
| N011Y | I067E | S133H | Y199W | N245C | L296V | S342Y | T387H |
| V012G | I067G | S133L | N200A | N245F | L296W | Q343C | T387I |
| V012H | I067P | S133M | N200F | N245L | L296Y | Q343D | T387L |
| V012W | I067R | S133N | N200G | N245P | G297C | Q343F | T387M |
| P013E | I067T | S133P | N200H | N245Q | G297E | Q343I | T387N |
| P013G | I067W | S133R | N200K | N245R | G297H | Q343P | T387V |
| P013I | D068A | S133T | N200L | N245S | G297L | Q343W | T387W |
| P013L | D068C | S133V | N200M | N245T | G297N | V344F | T387Y |
| P013M | D068G | S133W | N200P | N245V | G297Q | V344G | L388C |
| P013V | D068I | I134A | N200Q | R246A | G297R | V344H | L388G |
| F014A | D068L | I134C | N200R | R246C | G297S | V344L | L388P |
| F014E | D068P | I134D | N200S | R246D | G297T | V344M | L388Q |
| F014G | D068V | I134F | N200W | R246E | G297Y | V344N | L388S |
| F014H | D068Y | I134G | N200Y | R246G | A298C | V344P | E389F |
| F014K | S069N | I134H | G201A | R246H | A298E | V344Q | E389V |
| F014N | S069T | I134K | G201F | R246I | A298L | V344R | D390A |
| F014P | I070Q | I134P | G201L | R246K | A298M | V344S | D390C |
| F014Q | T071P | I134Q | G201M | R246L | A298N | V344T | D390E |
| F014W | G072C | I134R | G201N | R246M | A298P | V344W | D390F |
| L015E | G072F | I134S | G201P | R246P | A298Q | V344Y | D390G |
| L015F | G072H | I134W | G201R | R246S | A298S | L345A | D390H |
| L015G | G072I | E135P | G201S | R246T | A298T | L345C | D390L |
| L015K | G072P | L136P | G201T | R246V | A298W | L345E | D390N |
| L015N | G072V | V137F | G201V | R246W | A298Y | L345H | D390P |
| L015P | G072W | V137G | G201W | V247A | S299A | L345K | D390R |
| L015Q | V073P | V137H | S202A | V247C | S299C | L345N | D390S |
| L015R | V075D | V137N | S202E | V247F | S299D | L345Q | D390T |
| L015S | V075G | V137P | S202F | V247H | S299F | L345R | D390V |
| L015Y | V075P | V137R | S202G | V247N | S299H | L345T | D390W |
| W016A | N076A | V137W | S202H | V247P | S299H | L345V | D390W |
| W016C | N076C | V137Y | S202K | V247Q | S299H | L345Y | D390Y |
| W016D | N076F | Q138V | S202N | V247R | S299L | C346A | L391A |
| W016E | N076G | Q139P | S202P | V247S | S299M | C346D | L391D |
| W016F | N076I | Q143C | S202Q | V247T | S299P | C346F | L391G |
| W016G | N076L | Q143H | S202R | V247W | S299Q | C346G | L391H |
| W016H | N076L | Q143P | S202V | V247Y | S299T | C346I | L391K |
| W016K | N076P | Q143R | S202W | R248C | G300A | C346K | L391N |
| W016M | N076Q | Q143S | S202Y | R248D | G300C | C346L | L391P |
| W016P | N076R | Q143T | C203A | R248E | G300D | C346M | L391Q |
| W016R | N076S | L144A | C203D | R248G | G300E | C346P | L391R |
| W016S | N076T | L144E | C203E | R248I | G300F | C346R | L391S |
| W016T | N076V | L144F | C203G | R248M | G300L | C346S | L391T |
| W016Y | N076W | L144I | C203H | R248P | G300M | C346T | L391V |
| A017D | G077D | L144K | C203L | R248T | G300N | C346V | L391W |
| A017E | G077E | L144P | C203M | E249A | G300P | C346W | L391Y |
| A017G | G077L | L144Q | C203N | E249G | G300Q | Q347C | E392C |
| A017H | G077P | L144S | C203Q | E249H | G300S | Q347F | E392P |

TABLE 10-continued

Inactive Mutants

| | | | | | | | |
|---|---|---|---|---|---|---|---|
| A017I | G077Q | L144V | C203R | E249I | G300T | Q347I | Q393C |
| A017L | G077R | L144Y | C203S | E249K | G300V | Q347P | Q393P |
| A017N | G077T | S145T | C203T | E249M | G300W | Q347T | F394A |
| A017P | G077V | S145W | C203V | E249Q | I301E | Q347V | F394D |
| A017Q | G078A | A149E | F204A | E249S | I301G | Q347W | F394E |
| A017R | G078D | A149P | F204C | E249Y | I301H | E348C | F394G |
| A017S | G078I | T150V | F204E | A250C | I301K | E348H | F394I |
| A017T | G078M | K152L | F204G | A250F | I301M | E348I | F394K |
| A017V | G078P | A153E | F204H | A250G | I301N | E348L | F394N |
| A017W | G078T | A153F | F204I | A250H | I301P | E348P | F394P |
| A017Y | G078Y | A153M | F204K | A250K | I301Q | E348Q | F394Q |
| W018C | I079A | A153P | F204Q | A250L | I301R | E348R | F394R |
| W018D | I079D | A153R | F204R | A250M | I301S | E348T | F394S |
| W018F | I079F | A153T | F204S | A250N | I301W | E348V | F394T |
| W018G | I079G | A153V | F204T | A250P | I301Y | E348W | F394V |
| W018H | I079H | K154D | V206C | A250Q | V302C | E348Y | S395C |
| W018I | I079K | K154E | V206D | A250R | V302D | Q349D | S395L |
| W018L | I079N | K154G | V206F | A250S | V302E | Q349F | S395M |
| W018M | I079P | K154P | V206G | A250T | V302F | Q349G | S395P |
| W018P | I079S | K154S | V206P | A250V | V302G | Q349P | E396C |
| W018Q | I079W | K154W | V206Y | A250W | V302H | Q349V | E396F |
| W018S | I079Y | K154Y | E207A | I251D | V302L | Q349W | E396G |
| W018T | P080A | Q155P | E207F | I251F | V302M | Q349Y | E396I |
| W018V | P080D | Q155Y | E207G | I251G | V302P | G350A | E396P |
| W018Y | P080E | E156P | E207M | I251H | V302R | G350D | E396Y |
| N019A | P080F | F157A | E207P | I251K | V302S | G350E | K397A |
| N019C | P080G | F157C | E207Q | I251P | V302T | G350F | K397C |
| N019F | P080I | F157D | E207R | I251S | V302Y | G350H | K397E |
| N019G | P080K | F157E | E207S | I251T | I303A | G350K | K397F |
| N019H | P080L | F157G | E207T | I251W | I303C | G350L | K397G |
| N019I | P080M | F157H | E207V | R252A | I303D | G350M | K397I |
| N019L | P080N | F157I | E207W | R252D | I303E | G350N | K397M |
| N019M | P080R | F157K | I208D | R252E | I303F | G350P | K397P |
| N019P | P080S | F157L | I208G | R252F | I303G | G350R | K397Q |
| N019Q | P080T | F157M | I208P | R252G | I303K | G350S | K397T |
| N019R | P080V | F157P | I208W | R252H | I303L | G350T | K397V |
| N019S | P080Y | F157Q | K209C | R252I | I303M | G350V | F398A |
| N019V | Q081A | F157R | K209P | R252K | I303R | G350Y | F398C |
| N019W | Q081C | F157S | R210A | R252L | I303W | V351C | F398E |
| N019Y | Q081E | F157T | R210C | R252N | I303Y | V351D | F398G |
| A020D | Q081G | F157V | R210D | R252P | W304A | V351E | F398H |
| A020E | Q081H | E158D | R210E | R252S | W304C | V351F | F398I |
| A020F | Q081L | E158K | R210G | R252T | W304D | V351H | F398L |
| A020H | Q081N | E158P | R210K | R252V | W304G | V351N | F398N |
| A020K | Q081P | E158R | R210M | V253A | W304I | V351R | F398P |
| A020L | Q081S | E158Y | R210N | V253D | W304M | V351W | F398R |
| A020N | Q081V | K159W | R210P | V253E | W304N | V351Y | F398S |
| A020P | Q081W | K159Y | R210S | V253G | W304P | C352A | F398S |
| A020R | Q081Y | G161W | R210T | V253H | W304Q | C352D | F398T |
| A020T | K082W | D163C | R210V | V253L | W304S | C352E | F398V |
| A020V | K082Y | D163P | R210W | V253M | W304T | C352F | F398W |
| A020Y | I083E | F164A | R210Y | V253N | W304V | C352G | F398Y |
| P021A | I083K | F164C | N211C | V253Q | W304Y | C352K | Y399D |
| P021C | S084Y | F164D | N211F | V253R | G305L | C352M | Y399P |
| P021D | L085A | F164E | N211G | V253S | G305P | C352P | C400A |
| P021E | L085C | F164G | N211H | V253W | G305Q | C352Q | C400D |
| P021G | L085D | F164H | N211I | S254C | G305R | C352R | C400E |
| P021H | L085E | F164N | N211K | S254D | G305S | C352S | C400F |
| P021I | L085F | F164P | N211M | S254E | G305T | C352T | C400G |
| P021L | L085G | F164Q | N211P | S254G | G305V | C352V | C400I |
| P021M | L085H | F164R | N211P | S254I | G305Y | C352W | C400L |
| P021R | L085N | L165C | N211S | S254K | T306A | C352Y | C400M |
| P021S | L085Q | L165H | N211T | S254L | T306C | I353C | C400P |
| P021T | L085S | L165P | N211V | S254P | T306H | I353F | C400Q |
| P021V | L085T | L165T | N211W | S254Q | T306I | I353G | C400R |
| P021W | Q086C | V166D | D212A | S254R | T306L | I353H | C400S |
| S022C | Q086P | E167V | D212G | S254T | T306V | I353K | C400T |
| S022E | D087P | T168A | D212H | S254V | T306W | I353L | C400V |
| S022G | H088A | T168C | D212I | S254W | T306Y | I353M | C400Y |
| S022K | H088C | T168D | D212K | S254Y | L307C | I353Q | S401C |
| S022P | H088E | T168E | D212L | K255C | | I353R | S401F |
| E023A | H088F | T168F | D212M | K255D | L307I | I353S | S401H |
| E023F | H088G | T168G | D212P | K255L | L307P | I353W | S401K |
| E023L | H088I | T168K | D212V | K255P | S308C | R354C | S401R |
| E023M | H088K | T168L | D212W | K255V | S308F | R354D | S401W |
| E023N | H088L | T168P | D213P | K255W | S308L | R354E | S401Y |
| E023P | H088M | T168R | D213S | I256C | S308M | R354G | C402A |
| E023R | H088P | T168S | L214A | I256D | S308V | R354H | C402D |

TABLE 10-continued

Inactive Mutants

| | | | | | | | |
|---|---|---|---|---|---|---|---|
| E023S | H088R | T168V | L214C | I256E | S308W | R354I | C402E |
| E023T | H088S | T168W | L214D | I256G | S308Y | R354K | C402F |
| E023V | H088T | T168Y | L214E | I256P | M310C | R354L | C402L |
| C025D | H088V | I169A | L214G | P257D | M310E | R354M | C402M |
| C025E | H088Y | I169D | L214H | D258L | M310F | R354P | C402P |
| C025F | L089A | I169F | L214K | D258P | M310K | R354Q | C402Q |
| C025G | L089D | I169G | L214N | D258V | M310L | R354S | C402R |
| C025H | L089E | I169H | L214P | D258W | R311C | R354V | C402S |
| C025I | L089G | I169K | L214R | K260C | R311E | R354W | C402T |
| C025K | L089Q | I169N | L214S | K260P | R311F | R354Y | C402V |
| C025L | L089S | I169P | L214T | S261P | R311I | K355D | C402W |
| C025N | L089T | I169Q | L214Y | P262A | R311L | K355F | C402Y |
| C025P | L089W | I169S | S215C | P262D | R311P | K355G | Y403A |
| C025R | L089Y | I169T | S215P | P262E | R311V | K355H | Y403C |
| C025S | D090C | I169Y | W216D | P262F | R311W | K355L | Y403E |
| C025T | D090G | K170C | W216E | P262G | S312C | K355M | Y403G |
| C025V | K091D | K170D | W216G | P262H | S312E | K355N | Y403H |
| C025Y | K091E | K170E | W216H | P262I | S312M | K355P | Y403K |
| G027C | K091F | K170G | W216I | P262K | S312V | K355Q | Y403L |
| L033C | K091G | K170M | W216K | P262Q | S312W | K355R | Y403M |
| L033D | K091H | K170P | W216L | P262R | M313C | K355S | Y403N |
| L033H | K091I | K170W | W216M | P262S | K314C | K355T | Y403P |
| L033N | K091L | K170Y | W216N | P262T | K314L | K355V | Y403Q |
| L033V | K091N | L171C | W216P | P262V | K314W | K355W | Y403R |
| L033Y | K091T | L171D | W216Q | P262W | S315C | K355Y | Y403T |
| D034I | A092E | L171H | W216R | P262Y | S315I | N356C | S404C |
| D034L | A092F | L171M | W216T | L263E | S315V | N356G | S404D |
| D034N | A092H | L171N | W216V | L263F | C316E | N356K | S404F |
| D034S | A092K | L171R | L217A | L263P | C316G | N356L | S404G |
| D034T | A092P | L171S | L217C | L263Q | C316I | N356P | S404H |
| D034V | A092Q | L171W | L217G | L263W | C316K | N356R | S404L |
| M035A | A092R | L171Y | L217H | P264D | C316L | N356T | S404M |
| M035D | A092W | G172D | L217P | P264E | C316M | N356V | S404N |
| M035G | A092Y | G172E | L217Q | P264F | C316P | N356W | S404R |
| M035P | K094G | G172I | L217S | P264G | C316R | W357D | S404V |
| M035R | K094P | G172L | L217T | P264L | C316S | W357E | S404W |
| M035S | D095A | G172P | L217V | P264M | C316T | W357F | S404Y |
| S036C | D095C | G172Q | L217W | P264R | C316V | W357G | T405C |
| S036F | D095E | G172T | W218A | P264T | C316W | W357L | T405I |
| S036V | D095F | G172V | W218I | P264V | C316Y | W357M | T405V |
| S036W | D095G | G172W | W218K | P264W | L317G | W357Q | L406P |
| S036Y | D095H | G172Y | W218L | P264Y | L317P | W357R | L406R |
| L037C | D095K | K173D | W218P | V265A | L318C | N358E | C408A |
| L037E | D095L | K173E | W218S | V265D | L318P | N358H | C408E |
| L037G | D095M | K173G | W218V | V265F | L318W | N358I | C408F |
| L037N | D095P | K173H | N219P | V265G | L319C | N358K | C408G |
| L037S | D095Q | K173I | E220G | V265H | L319E | N358P | C408I |
| F038E | D095S | K173L | E220K | V265K | L319F | N358Q | C408K |
| F038G | D095V | K173M | E220N | V265L | L319G | N358R | C408L |
| F038K | D095W | K173P | E220P | V265M | L319H | N358W | C408P |
| F038L | D095Y | K173S | E220R | V265N | L319I | S359A | C408R |
| F038N | I096A | K173V | E220W | V265Q | L319K | S359F | C408S |
| F038Q | I096C | K173W | S221D | V265R | L319M | S359G | C408T |
| F038R | I096G | K173Y | S221E | V265S | L319P | S359L | C408V |
| F038T | I096H | L174P | S221H | F266A | L319Q | S359P | C408W |
| F038W | I096P | L175C | S221K | F266C | L319R | S359W | C408Y |
| S039C | I096R | L175D | S221P | F266G | L319S | S360A | E410W |
| S039D | I096S | L175G | S221R | F266H | L319V | S360C | K411D |
| S039F | I096T | L175K | T222P | F266M | L319W | S360E | K411E |
| S039W | I096W | L175P | T222Y | F266P | L319Y | S360F | K411F |
| F040A | F098P | L175R | A223C | F266Q | D320C | S360G | K411G |
| F040D | Y099C | L175S | A223D | F266R | D320P | S360I | A412E |
| F040E | Y099E | R176A | A223E | F266S | D320V | S360K | A412H |
| F040G | Y099G | R176C | A223G | F266T | N321E | S360L | D413H |
| F040K | Y099I | R176E | A223H | F266V | N321M | S360P | D413I |
| F040N | Y099N | R176F | A223K | F266W | N321P | S360Q | D413K |
| F040R | Y099P | R176G | A223L | A267D | Y322C | S360R | D413L |
| F040S | Y099V | R176H | A223P | A267G | Y322D | S360V | D413P |
| F040T | Y099W | R176I | A223Q | A267H | Y322E | V414A | |
| F040V | M100C | R176P | A223R | A267I | Y322G | D361A | V414D |
| I041Q | M100E | R176Q | A223S | A267K | Y322I | D361C | V414E |
| G042D | M100F | R176S | A223T | A267N | Y322L | D361E | V414G |
| G042E | M100G | R176T | A223V | A267R | Y322N | D361G | V414H |
| G042H | M100N | R176V | A223W | A267S | Y322P | D361M | V414K |
| G042I | M100P | R176W | A223Y | A267W | Y322R | D361N | V414R |
| G042K | M100R | P177A | L224A | Y268A | Y322S | D361P | V414S |
| G042L | M100S | P177C | L224D | Y268C | Y322T | D361Q | V414T |
| G042M | M100T | P177D | L224E | Y268F | Y322V | D361R | K415C |

TABLE 10-continued

Inactive Mutants

| | | | | | | | |
|---|---|---|---|---|---|---|---|
| G042P | M100W | P177F | L224F | Y268G | Y322W | D361S | K415D |
| G042Q | M100Y | P177G | L224G | Y268H | M323A | D361V | K415E |
| G042R | P101A | P177H | L224M | Y268K | M323C | D361W | K415P |
| G042S | P101C | P177L | L224P | Y268L | M323E | Y362A | D416C |
| G042T | P101F | P177M | L224Q | Y268N | M323G | Y362C | D416S |
| G042V | P101H | P177Q | L224R | Y268P | M323H | Y362E | T417A |
| S043A | P101I | P177R | L224S | Y268Q | M323K | Y362G | T417D |
| S043E | P101K | P177S | L224T | Y268S | M323N | Y362H | T417E |
| S043F | P101L | P177T | L224W | Y268T | M323R | Y362K | T417F |
| S043G | P101M | P177V | L224Y | Y268V | M323S | Y362L | T417G |
| S043I | P101N | P177W | Y225A | Y268W | M323T | Y362M | T417H |
| S043K | P101Q | N178E | Y225D | T269E | M323V | Y362N | T417K |
| S043L | P101R | N178I | Y225E | T269K | E324C | Y362P | T417M |
| S043Q | P101S | N178L | Y225G | T269L | E324F | Y362R | T417P |
| S043R | P101T | N178V | Y225H | T269M | E324P | Y362S | T417Q |
| S043V | V102P | N178W | Y225K | T269N | E324V | Y362T | T417R |
| P044A | D103A | N178Y | Y225P | T269P | E324W | Y362V | A419D |
| P044C | D103E | H179W | Y225Q | T269Q | E324Y | Y362W | A419P |
| P044F | D103F | L180A | Y225R | T269R | T325C | L363A | V420A |
| P044G | D103G | L180C | Y225T | R270A | T325R | L363C | V420D |
| P044H | D103H | L180E | Y225V | R270C | I326E | L363D | V420F |
| P044I | D103I | L180P | Y225W | R270E | I326G | L363E | V420G |
| P044L | D103L | L180R | P226A | R270F | I326H | L363F | V420H |
| P044N | D103Q | L180S | P226C | R270G | I326N | L363G | V420K |
| P044Q | D103R | W181A | P226D | R270H | I326W | L363H | V420L |
| P044R | D103T | W181C | P226E | R270I | L327A | L363I | V420N |
| P044S | D103V | W181D | P226F | R270P | L327E | L363P | V420R |
| P044T | D103W | W181E | P226G | R270Y | L327F | L363Q | V420S |
| P044W | D103Y | W181F | P226L | I271A | L327G | L363R | V420T |
| P044Y | N104F | W181H | P226N | I271D | L327H | L363S | V420W |
| R045A | N104P | W181I | P226Q | I271E | L327N | L363T | V420Y |
| R045D | N104W | W181K | P226R | I271H | L327Q | L363V | V422C |
| R045F | L105C | W181L | P226S | I271K | L327R | L363W | V422D |
| R045G | L105M | W181R | P226T | I271T | L327S | H364A | V422G |
| R045P | L105N | W181S | P226V | I271W | L327T | H364C | V422H |
| R045W | G106A | W181V | P226W | V272A | L327V | H364D | V422L |
| I046P | G106C | G182A | P226Y | V272H | L327W | H364E | V422M |
| I046W | G106D | G182C | S227A | V272L | L327Y | H364F | V422N |
| N047V | G106F | G182D | S227F | V272N | P329C | H364G | V422Q |
| A048P | G106H | G182E | S227G | V272P | P329F | H364K | V422R |
| T049C | G106K | G182H | S227H | V272W | P329G | H364L | V422S |
| T049D | G106L | G182N | S227I | F273A | P329H | H364M | V422Y |
| T049G | G106M | G182P | S227K | F273C | P329I | H364P | C423A |
| T049H | G106N | G182Q | S227L | F273D | P329K | H364R | C423E |
| T049P | G106P | G182R | S227M | F273G | P329L | H364S | C423F |
| | G106S | G182S | S227P | F273I | P329N | H364T | C423G |
| | G106W | G182T | S227Q | F273L | P329Q | H364V | C423H |
| Q051C | G106Y | G182V | S227R | F273P | P329R | H364Y | C423L |
| Q051F | M107A | G182Y | S227T | F273Q | P329S | L365A | C423M |
| Q051I | M107C | Y183C | S227V | F273S | P329T | L365C | C423P |
| Q051M | M107H | Y183D | S227W | F273V | P329V | L365D | C423Q |
| Q051P | M107K | Y183E | S227Y | F273W | P329W | L365E | C423R |
| Q051T | M107P | Y183G | I228A | T274C | P329Y | L365G | C423S |
| Q051W | M107Q | Y183I | I228E | T274E | Y330A | L365M | C423T |
| Q051Y | M107S | Y183K | I228F | T274G | Y330C | L365N | C423V |
| G052C | M107V | Y183N | I228G | T274H | Y330D | L365P | C423W |
| G052E | M107W | Y183P | I228H | T274N | Y330E | L365Q | C423Y |
| G052F | A108D | Y183Q | I228L | T274Q | Y330G | L365R | I424A |
| G052W | A108E | Y183R | I228M | T274W | Y330I | L365S | I424C |
| G052Y | A108F | Y183S | I228N | T274Y | Y330L | L365T | I424E |
| V053A | A108K | Y183V | I228P | D275A | Y330M | L365W | I424G |
| V053C | A108L | Y184A | I228R | D275F | Y330N | L365Y | I424H |
| V053D | A108M | Y184C | I228S | D275G | Y330P | N366A | I424N |
| V053E | A108P | Y184D | I228T | D275I | Y330R | N366C | I424Q |
| V053G | A108Q | Y184E | I228W | D275K | Y330S | N366D | I424R |
| V053H | A108T | Y184F | Y229E | D275L | Y330V | N366F | I424S |
| V053L | A108V | Y184G | Y229F | D275M | Y330W | N366G | I424W |
| V053N | A108Y | Y184H | Y229G | D275Q | I331A | N366K | I424Y |
| V053P | V109C | Y184K | Y229K | D275T | I331C | N366M | A425E |
| V053Q | V109D | Y184L | Y229L | D275V | I331D | N366P | A425L |
| V053R | V109E | Y184M | Y229P | D275W | I331E | N366Q | A425P |
| V053S | V109L | Y184P | Y229Q | Q276F | I331F | N366R | A425W |
| V053T | V109M | Y184R | Y229T | Q276W | I331H | N366T | A425Y |
| V053W | V109R | Y184S | Y229V | L278M | I331K | N366W | D426C |
| V053Y | V109T | Y184V | Y229W | L278P | I331Q | P367E | D426F |
| T054D | V109W | L185A | L230A | L278P | I331R | P367F | D426M |
| T054E | I110F | L185D | L230E | K279A | I331S | P367I | D426R |
| T054G | I110K | L185E | L230G | K279C | I331T | P367L | G427A |
| T054P | I110L | | | | | | |

TABLE 10-continued

Inactive Mutants

| | | | | | | | |
|---|---|---|---|---|---|---|---|
| T054R | I110M | L185F | L230H | K279F | I331W | P367M | G427C |
| T054Y | I110P | L185G | L230K | K279G | I331Y | P367Q | G427F |
| I055A | I110W | L185I | L230M | K279L | I332C | P367V | G427L |
| I055D | D111H | L185K | L230N | K279W | I332D | D368C | G427P |
| I055G | D111I | L185P | L230P | K279Y | I332E | D368P | |
| I055H | D111Q | L185R | L230R | F280D | I332F | D368W | G427V |
| I055N | W112C | L185S | L230S | F280I | I332G | N369C | G427W |
| I055P | W112E | L185T | L230T | F280L | I332H | N369E | G427Y |
| I055Q | W112G | L185V | L230V | F280M | I332K | N369F | V428A |
| I055R | W112H | L185W | L230W | F280N | I332L | N369I | V428C |
| I055T | W112L | L185Y | L230Y | F280R | I332N | N369K | V428D |
| I055V | W112N | F186A | N231A | F280S | I332P | N369L | V428E |
| I055Y | W112P | F186D | N231C | F280T | I332R | N369P | V428G |
| F056A | W112S | F186G | N231D | F280V | I332S | N369Q | V428H |
| F056C | E113R | F186H | N231F | F280W | I332T | N369V | V428N |
| F056E | E113V | F186I | N231G | L281A | I332Y | N369W | V428R |
| F056G | E114I | F186K | N231H | L281D | N333G | F370A | V428S |
| F056H | E114L | F186L | N231I | L281G | N333H | F370D | V428Y |
| F056I | E114P | F186N | N231K | L281H | N333I | F370E | C429A |
| F056K | E114T | F186P | N231L | L281I | N333K | F370G | C429D |
| F056L | E114V | F186Q | N231P | L281K | N333P | F370H | C429K |
| F056P | W115A | F186R | N231Q | L281N | N333R | F370K | C429L |
| F056R | W115C | F186S | N231R | L281P | N333S | F370L | C429N |
| F056S | W115D | F186V | N231S | L281Q | N333T | F370N | C429P |
| F056T | W115F | F186W | N231V | L281R | N333W | F370P | C429S |
| F056V | W115G | P187A | T232C | L281S | N333Y | F370Q | C429T |
| F056W | W115H | P187F | T232G | L281V | V334A | F370R | C429W |
| Y057A | W115I | P187G | T232H | L281W | V334C | F370S | C429Y |
| Y057D | W115K | P187H | T232K | S282F | V334D | F370V | I430A |
| Y057F | W115L | P187I | T232L | S282L | V334E | F370Y | I430D |
| Y057G | W115M | P187L | T232N | S282V | V334G | A371P | I430E |
| Y057I | W115R | P187M | T232P | S282W | V334M | A371W | I430L |
| Y057L | W115S | P187N | T232Q | S282Y | V334N | I372A | I430M |
| Y057M | W115V | P187Q | T232V | Q283A | V334R | I372D | I430N |
| Y057P | W115Y | P187R | T232Y | Q283C | V334S | I372E | I430S |
| Y057Q | R116A | P187S | Q233D | Q283D | T335F | I372F | I430T |
| Y057R | R116C | P187T | Q233I | Q283F | T335G | I372G | I430V |
| Y057V | R116D | P187V | Q233P | Q283W | T335H | I372H | D431P |
| Y057W | R116E | P187W | Q233S | D284C | T335I | I372K | A432C |
| V058A | R116G | P187Y | Q233T | D284I | T335J | I372L | A432F |
| D059A | R116H | D188A | Q234A | D284P | T335K | I372N | A432I |
| D059E | R116I | D188C | Q234D | E285K | T335L | I372P | A432K |
| D059I | R116L | D188F | Q234E | E285P | T335P | I372R | A432L |
| D059L | R116N | D188G | Q234G | E285R | T335V | I372S | A432M |
| D059M | R116P | D188H | Q234H | E285T | T335W | I372T | A432P |
| D059P | R116Q | D188L | Q234N | E285V | T335Y | I372V | A432Y |
| D059R | R116S | D188M | Q234P | L286A | L336A | I372W | L434H |
| D059T | R116V | D188N | Q234S | L286C | L336E | Q373C | L434K |
| D059V | R116W | D188P | Q234T | L286D | L336F | Q373P | L434P |
| D059W | P117D | D188Q | Q234V | L286F | L336G | Q373W | L434Q |
| D059Y | P117G | D188R | Q234W | L286H | L336K | L374D | L434R |
| R060A | P117I | D188S | S235F | L286K | L336N | L374E | L434W |
| R060D | P117K | D188T | S235L | L286M | L336P | E375C | P437T |
| R060F | P117N | D188V | S235M | L286P | L336R | E375F | M438Y |
| R060G | P117Q | D188W | S235R | L286T | L336S | E375P | E439N |
| R060H | P117R | C189A | S235W | L286Y | L336T | E375V | E439R |
| R060I | P117S | C189E | S235Y | V287A | L336V | E375Y | T440Q |
| R060L | P117V | C189G | P236C | V287C | R121G | K376I | E441R |
| R060N | P117W | C189H | W119L | V287D | R121H | K376P | E442M |
| R060P | T118C | C189K | W119N | V287E | R121K | K376W | E442N |
| R060Q | T118D | C189L | W119P | V287G | R121L | G377C | E442S |
| R060S | T118E | C189M | W119R | V287K | R121M | G377I | P443D |
| R060T | T118G | C189N | R121A | V287L | R121P | G377L | G378E |
| T118R | T118P | T118W | R121C | R121F | G378D | G377V | |
| T118Y | W119I | W119A | W119K | R121E | G378F | G378I | |

Example 5

Assay for Hyaluronidase Activity Under Temperature and Phenophilic Conditions

Supernatants from PH20 activity variants set forth in Table 9, as identified in Example 4, were tested for stability under thermophilic and/or phenophilic conditions. The assay to measure hyaluronidase activity under temperature and phenophile conditions using biotinylated-HA (bHA) as substrate for measuring hyaluronidase activity was modified from the original assay described in Example 3 in that it incorporated a 4-hour 37° C. incubation of samples with or without m-cresol prior to measurement of enzymatic activity. The assay was used to identify PH20 mutants with thermophilic properties (activity greater at 37° C. condition than at 4° C.) and/or with phenolphilic properties (greater activity in the presence of m-cresol than wildtype PH20).

1. Primary Screen

Prior to incubating samples with bHA, variant PH20 samples were diluted into designated wells of an uncoated 4×HB plate for pre-incubation at 37° C. for 4 hours under the following conditions: 1) pre-incubation at 37° C. with 0.4% m-cresol; and 2) pre-incubation at 37° C. without 0.4% m-cresol. For the preincubation at 37° C. with 0.4% m-cresol, a 1% m-cresol intermediate stock was prepared from 50% (v/v) m-cresol stock solution. Briefly, in a 2 mL Wheaton glass vial a 50% stock of m-cresol (Fluka, Catalog No. 65996; Spectrum, Catalog No. C2773) was made in methanol based on the density (D=1.034 g/L). The vial was sealed and stored at −20° C. with protection from light in small aliquotes. Then, the 1% intermediate stock was generated by dilution in HEPES assay buffer (10 mM HEPES, 50 mM NaCl, 1 mM $CaCl_2$, 1 mg/mL BSA, pH 7.4, 0.05% Tween-20) daily immediately prior to use in a fume hood with vortexing.

Then, duplicates of transfected variant supernatant samples set forth in Table 9, generated as described above in Example 2, were each separately subjected to a 1:2.5 dilution of 1% m-cresol in HEPES assay buffer/transfected supernatant to obtain 0.4% final concentration of m-cresol. For the preincubation at 37° C. without 0.4% m-cresol, transfected variant supernatant samples were subjected to a 1:2.5 dilution in HEPES assay buffer/transfected supernatant. In addition, for each condition, an internal killing control was also tested by spiking in 3 U/mL of rHuPH20 in pH 7.4 HEPES buffer (generated as described in Example 1) that was diluted the same as described above for the transfected samples. The plates were sealed with plate sealers and incubated at 37° C. for 4 hours.

The preparation of the bHA coated plates and blocking of the plates prior to addition of the transfected variant supernatants or wildtype PH20 was the same as described in Example 3. The assay was further modified as follows. First, samples were diluted in duplicate 1:10 in HEPES assay buffer in 4×HB plates. For each variant, the samples that were tested were 1) non-preincubated transfected variant supernatant (no incubation; 4° C.); 2) preincubated transfected variant supernatants preincubated at 37° C. for 4 hours with 0.4% m-cresol (Cresol); or 3) preincubated transfected variant supernatant preincubated at 37° C. for 4 hours without 0.4% m-cresol (no cresol; 37° C.). In addition, the spiked-in samples also were tested. A standard curve using rHuPH20 was made as described in Example 3 without m-cresol. One hundred microliters (100 µl) of each standard and sample were transferred to pre-designated wells of the bHA-coated and blocked plate and incubated for approximately 1.5 hours at 37° C. Thus, each sample of each variant was tested in quadruplicate due to the preincubation of duplicate samples of each transfected variant supernatants in the pre-incubation step and the further duplicate of each sample in the bHA assay.

After the incubation, the plates were washed and binding to bHA detected as described above in Example 3. Optical density was measured at 450 nm within 30 minutes of adding the stop solution.

The U/mL activity was calculated from the standard curve and compared. The results were depicted as the percent (%) activity remaining under each of the following parameters: ratio of activity at 1) 37° C. preincubation without m-cresol/4° C.; 2) 37° C. after preincubation with m-cresol/4° C.; and 3) 37° C. after preincubation with m-cresol/after preincubation at 37° C. without m-cresol. Initial phenophile hits for reconfirmation were identified as those that in a duplicate assay exhibited a percentage of remaining activity under condition 3) of ≥20% of the original activity at 37° C.

Initial Hits were rescreened using a 6-well plate rescreen assay. For the rescreen, plasmid DNA corresponding to the potential Hit was transformed into E. coli bacteria and plasmid DNA prepared and purified using MaxiPrep according to the manufacturers instructions. The DNA sequence was confirmed.

The plasmid DNA was transfected into monolayer CHO—S cells (Invitrogen, Cat. No. 11619-012) grown on 6-well plates at a density of about 50-80% confluency using Lipofectamine 2000 (Invitrogen, Cat. No. 11668-027) according to the protocol suggested by the manufacturer. Transfections were performed in duplicate. The cells were incubated at 37° C. in a $CO_2$ incubator for 96 hours post-transfection before collecting the supernatant for the assay. As controls, cells also were transfected with the HZ24-PH20 (OHO)-IRES-SEAP expression vector (SEQ ID NO:4) that contains a codon-optimized wildtype PH20 sequence (OHO). Mock cells also were included as controls.

Ninety-Six (96) hours post-transfections, supernatant was collected from each sample, including the OHO and mock controls, and assayed for hyaluronidase activity under various conditions as described above: 1) non-preincubated transfected variant supernatant (no incubation; 4° C.); 2) preincubated transfected variant supernatants preincubated at 37° C. for 4 hours with 0.4% m-cresol (Cresol; 37° C.); or 3) preincubated transfected variant supernatant preincubated at 37° C. for 4 hours without 0.4% m-cresol (no cresol; 37° C.). Hyaluronidase activity was determined as described above using the bHA assay.

The results were assessed as described above. Absolute hyaluronidase activity (U/mL) was generated from the standard curve. In addition, percent activity was determined as a ratio of activity at 37° C./4° C., 37° C. plus m-cresol/4° C., and 37° C. plus m-cresol/37° C. The results are set forth in Tables 11 and 12 below.

TABLE 11

Absolute Hyaluronidase Activity

| Mutant | No incubation (4° C.) | | 37° C. no cresol (37° C.) | | 37° C. with m-cresol (37° C. plus m-cresol) | |
|---|---|---|---|---|---|---|
| L001A | 2.993 | 2.511 | 3.529 | 3.214 | 0.287 | 0.295 |
| L001E | 2.669 | 2.539 | 2.862 | 3.179 | 0.376 | 0.341 |
| L001G | 0.348 | 0.583 | 0.596 | 0.676 | 0.055 | 0.031 |
| L001Q | 5.135 | 6.443 | 6.133 | 5.719 | 0.621 | 0.636 |
| L001R | 5.603 | 4.390 | 6.576 | 7.042 | 0.458 | 0.396 |
| P006A | 2.965 | 3.208 | 4.088 | 3.495 | 0.404 | 0.435 |
| V008M | 1.376 | 1.401 | 1.856 | 1.678 | 0.000 | 0.008 |
| I009Q | 0.447 | 0.381 | 0.469 | 0.476 | 0.031 | 0.030 |
| P010G | 0.747 | 0.564 | 0.820 | 0.688 | 0.123 | 0.114 |
| P010H | 0.473 | 0.485 | 0.624 | 0.548 | 0.000 | 0.000 |
| N011S | 0.862 | 0.962 | 1.313 | 1.263 | 0.094 | 0.064 |
| V012E | 11.019 | 5.519 | 5.312 | 5.528 | 0.753 | 0.934 |
| V012I | 2.804 | 3.844 | 3.610 | 6.566 | 0.106 | 0.090 |
| V012K | 1.691 | 1.963 | 2.479 | 2.243 | 0.330 | 0.321 |
| F014V | 0.144 | 0.165 | 0.222 | 0.242 | 0.003 | 0.000 |
| L015M | 0.902 | 1.073 | 1.026 | 0.901 | 0.017 | 0.017 |
| A020S | 1.494 | 2.205 | 2.822 | 2.620 | 0.413 | 0.397 |
| S022T | 3.035 | 3.788 | 3.375 | 3.273 | 0.684 | 0.748 |
| L026M | 1.482 | 1.226 | 2.027 | 1.704 | 0.224 | 0.178 |
| K028R | 0.944 | 0.845 | 1.043 | 0.925 | 0.112 | 0.095 |
| F029R | 1.195 | 1.511 | 1.848 | 1.839 | 0.140 | 0.140 |
| F029S | 3.019 | 3.615 | 3.566 | 3.521 | 0.250 | 0.283 |
| F029T | 1.451 | 1.712 | 1.839 | 2.065 | 0.220 | 0.212 |
| P032C | 0.370 | 0.419 | 0.476 | 0.534 | 0.006 | 0.040 |
| L033G | 0.566 | 0.700 | 0.686 | 0.627 | 0.001 | 0.026 |
| D034W | 0.340 | 0.321 | 0.499 | 0.471 | 0.076 | 0.069 |

TABLE 11-continued

Absolute Hyaluronidase Activity

| Mutant | No incubation (4° C.) | | 37° C. no cresol (37° C.) | | 37° C. with m-cresol (37° C. plus m-cresol) | |
|---|---|---|---|---|---|---|
| M035V | 0.887 | 0.639 | 0.721 | 0.652 | 0.116 | 0.023 |
| S036H | 1.109 | 0.752 | 1.178 | 1.135 | 0.117 | 0.026 |
| S036N | 0.797 | 0.933 | 0.893 | 0.859 | 0.171 | 0.260 |
| L037M | 0.574 | 0.404 | 0.455 | 0.353 | 0.049 | 0.032 |
| F040L | 2.603 | 3.941 | 3.515 | 4.148 | 0.277 | 0.361 |
| I046L | 3.027 | 2.959 | 4.011 | 3.342 | 0.513 | 0.557 |
| N047D | 2.222 | 2.359 | 2.573 | 2.639 | 0.032 | 0.021 |
| N047W | 0.404 | 0.415 | 0.423 | 0.456 | 0.000 | 0.017 |
| A048N | 12.398 | 45.971 | 14.252 | 23.873 | 0.797 | 0.902 |
| T049R | 7.893 | 13.334 | 9.685 | 12.102 | 0.563 | 0.649 |
| G050D | 3.287 | 3.148 | 3.084 | 3.020 | 0.242 | 0.264 |
| G050M | 1.763 | 2.333 | 2.780 | 3.244 | 0.250 | 0.393 |
| G052N | 7.217 | 9.809 | 6.939 | 13.978 | 1.109 | 1.083 |
| G052T | 1.542 | 1.224 | 1.795 | 1.433 | 0.381 | 0.463 |
| G052S | 2.152 | 1.999 | 2.120 | 1.963 | 0.498 | 0.566 |
| V058C | 1.428 | 1.312 | 1.321 | 1.301 | 0.212 | 0.210 |
| V058K | 28.000 | 28.000 | 61.016 | 61.016 | 23.586 | 23.586 |
| V058R | 5.719 | 4.688 | 5.542 | 4.822 | 3.134 | 3.149 |
| V058N | 1.200 | 1.175 | 1.550 | 1.525 | 0.200 | 0.175 |
| V058Y | 1.040 | 0.770 | 1.071 | 1.088 | 0.388 | 0.454 |
| V058Q | 11.956 | 15.363 | 18.458 | 45.092 | 1.567 | 2.166 |
| V058P | 3.360 | 2.949 | 2.799 | 5.121 | 0.592 | 0.884 |
| V058H | 3.790 | 5.074 | 7.590 | 9.222 | 0.826 | 1.205 |
| D068P | 0.215 | 0.215 | 0.213 | 0.180 | 0.001 | 0.184 |
| S069T | 1.927 | 2.179 | 2.671 | 2.671 | 0.289 | 0.240 |
| I070P | 1.284 | 1.593 | 1.306 | 1.589 | 0.010 | 0.032 |
| I070V | 1.818 | 2.437 | 3.099 | 3.335 | 0.433 | 0.363 |
| V073Q | 4.846 | 5.441 | 5.880 | 5.827 | 0.383 | 0.477 |
| V073R | 0.522 | 0.803 | 0.720 | 0.804 | 0.018 | 0.059 |
| T074E | 2.903 | 3.834 | 3.868 | 3.871 | 0.666 | 0.626 |
| T074M | 0.569 | 0.744 | 0.656 | 0.771 | 0.079 | 0.083 |
| T074N | 2.792 | 1.905 | 2.565 | 2.995 | 0.281 | 0.204 |
| T074P | 2.331 | 1.593 | 2.525 | 2.648 | 0.309 | 0.265 |
| T074R | 0.999 | 0.820 | 0.806 | 1.066 | 0.060 | 0.023 |
| T074V | 1.186 | 1.280 | 1.365 | 1.460 | 0.101 | 0.080 |
| V075M | 0.917 | 1.087 | 1.233 | 1.321 | 0.003 | 0.028 |
| K082L | 1.362 | 1.311 | 1.563 | 3.302 | 0.325 | 0.354 |
| K082N | 3.202 | 3.411 | 3.396 | 3.244 | 0.792 | 0.861 |
| I083V | 3.706 | 2.633 | 5.194 | 3.615 | 1.552 | 1.017 |
| I083Q | 2.376 | 1.946 | 2.665 | 3.674 | 0.720 | 0.510 |
| I083S | 0.841 | 1.054 | 0.880 | 1.005 | 0.235 | 0.268 |
| I083G | 2.276 | 2.443 | 2.418 | 1.866 | 0.545 | 0.601 |
| S084E | 1.470 | 1.484 | 1.834 | 1.683 | 0.115 | 0.115 |
| S084F | 1.179 | 1.212 | 0.982 | 1.103 | 0.025 | 0.000 |
| S084N | 2.255 | 1.888 | 3.268 | 2.476 | 0.597 | 0.547 |
| S084R | 8.534 | 14.779 | 10.230 | 30.016 | 1.117 | 1.494 |
| Q086A | 2.084 | 2.120 | 2.845 | 3.310 | 0.405 | 0.322 |
| Q086H | 1.187 | 1.000 | 1.218 | 1.296 | 0.087 | 0.065 |
| Q086K | 0.127 | 0.110 | 0.126 | 0.072 | 0.032 | 0.022 |
| Q086S | 2.528 | 2.082 | 2.539 | 2.149 | 0.173 | 0.241 |
| Q086T | 3.018 | 2.542 | 2.832 | 4.562 | 0.290 | 0.406 |
| D087G | 2.755 | 2.176 | 2.252 | 1.971 | 0.034 | 0.122 |
| D087L | 2.070 | 2.277 | 2.195 | 2.311 | 0.324 | 0.299 |
| D087M | 2.262 | 2.325 | 2.510 | 2.038 | 0.191 | 0.335 |
| D087S | 5.210 | 10.305 | 6.983 | 14.399 | 0.569 | 0.928 |
| D087V | 1.361 | 1.364 | 1.553 | 1.187 | 0.142 | 0.189 |
| D090E | 8.251 | 12.299 | 7.666 | 19.836 | 1.093 | 1.234 |
| D090N | 2.812 | 2.775 | 3.123 | 2.737 | 0.379 | 0.290 |
| K093Q | 2.491 | 2.065 | 2.267 | 1.971 | 0.132 | 0.131 |
| K093R | 2.986 | 2.862 | 3.094 | 2.842 | 0.362 | 0.465 |
| K094D | 2.393 | 2.408 | 2.071 | 2.132 | 0.135 | 0.211 |
| K094R | 1.407 | 1.542 | 1.764 | 1.676 | 0.158 | 0.166 |
| T097C | 0.330 | 0.618 | 0.545 | 0.505 | 0.044 | 0.087 |
| T097D | 0.520 | 0.565 | 0.643 | 0.664 | 0.055 | 0.073 |
| T097E | 1.096 | 1.410 | 1.394 | 1.623 | 0.217 | 0.262 |
| T097L | 0.899 | 1.198 | 1.065 | 1.241 | 0.246 | 0.300 |
| N104R | 2.508 | 2.356 | 2.876 | 2.790 | 0.279 | 0.238 |
| A120H | 2.155 | 2.551 | 2.028 | 2.883 | 0.168 | 0.199 |
| D127R | 0.264 | 0.339 | 0.149 | 0.199 | 0.105 | 0.068 |
| V128I | 3.120 | 3.313 | 3.546 | 3.401 | 0.389 | 0.504 |
| N131M | 15.335 | 20.678 | 27.143 | 15.899 | 0.505 | 0.447 |
| N131R | 8.195 | 8.748 | 7.724 | 8.392 | 1.645 | 1.626 |
| N131V | 1.656 | 1.870 | 2.280 | 1.962 | 0.233 | 0.214 |
| R132L | 3.306 | 3.235 | 3.259 | 2.966 | 0.337 | 0.430 |
| Q138L | 1.494 | 1.660 | 1.611 | 1.521 | 0.410 | 0.347 |
| Q140K | 2.829 | 4.065 | 4.996 | 4.464 | 0.546 | 0.559 |
| N141R | 1.290 | 1.320 | 1.334 | 1.527 | 0.058 | 0.035 |
| N141S | 2.201 | 2.708 | 2.900 | 2.966 | 0.135 | 0.164 |
| N141W | 1.475 | 1.568 | 1.927 | 1.643 | 0.100 | 0.105 |
| V142D | 2.552 | 2.186 | 2.914 | 3.193 | 0.128 | 0.067 |
| V142G | 1.357 | 1.796 | 1.597 | 1.621 | 0.211 | 0.219 |
| V142K | 3.532 | 2.381 | 3.867 | 3.681 | 0.571 | 0.575 |
| V142N | 0.432 | 0.567 | 0.672 | 0.589 | 0.103 | 0.087 |
| V142P | 4.624 | 7.213 | 7.722 | 7.021 | 1.074 | 1.081 |
| V142Q | 5.090 | 6.900 | 7.618 | 6.897 | 0.678 | 0.678 |
| V142R | 1.968 | 2.595 | 2.941 | 2.689 | 0.364 | 0.330 |
| V142S | 2.789 | 2.988 | 4.763 | 3.497 | 0.416 | 0.591 |
| V142T | 1.926 | 3.260 | 4.313 | 4.031 | 0.495 | 0.472 |
| Q143G | 3.922 | 4.903 | 5.632 | 4.846 | 0.782 | 0.780 |
| Q143K | 3.634 | 3.671 | 7.285 | 5.008 | 1.043 | 1.039 |
| L144R | 3.810 | 4.581 | 5.191 | 5.107 | 0.556 | 0.520 |
| L144T | 1.496 | 1.681 | 1.941 | 1.831 | 0.285 | 0.219 |
| L146P | 0.818 | 0.782 | 0.954 | 0.904 | 0.011 | 0.031 |
| T147S | 0.984 | 1.149 | 1.399 | 1.497 | 0.055 | 0.039 |
| T150N | 0.442 | 0.585 | 0.622 | 0.684 | 0.039 | 0.046 |
| T150S | 1.747 | 1.400 | 1.875 | 1.988 | 0.120 | 0.121 |
| E151A | 2.870 | 2.269 | 2.965 | 2.860 | 0.359 | 0.337 |
| E151L | 3.365 | 3.289 | 4.446 | 4.007 | 0.218 | 0.251 |
| E151S | 5.187 | 4.591 | 5.987 | 6.262 | 0.371 | 0.294 |
| E151T | 2.442 | 3.000 | 3.134 | 3.309 | 0.000 | 0.000 |
| E151V | 3.998 | 4.247 | 4.459 | 4.232 | 0.326 | 0.314 |
| E151W | 7.166 | 14.248 | 11.352 | 13.524 | 0.131 | 0.121 |
| K152T | 1.204 | 1.377 | 1.796 | 1.883 | 0.100 | 0.067 |
| K152W | 2.084 | 1.795 | 2.549 | 2.406 | 0.063 | 0.069 |
| E158S | 0.339 | 0.397 | 0.451 | 0.407 | 0.000 | 0.000 |
| K162E | 0.168 | 0.195 | 0.114 | 0.080 | 0.004 | 0.024 |
| L165F | 4.775 | 5.250 | 5.075 | 5.075 | 0.600 | 0.725 |
| V166Q | 1.883 | 2.507 | 2.937 | 2.958 | 0.392 | 0.324 |
| V166T | 0.993 | 1.315 | 1.821 | 1.800 | 0.231 | 0.235 |
| E167D | 0.811 | 0.910 | 1.109 | 1.480 | 0.111 | 0.056 |
| I169L | 1.812 | 1.796 | 2.540 | 2.196 | 0.335 | 0.341 |
| K170R | 1.578 | 2.054 | 2.536 | 1.995 | 0.209 | 0.201 |
| G172A | 0.413 | 0.581 | 0.692 | 0.777 | 0.052 | 0.056 |
| K173R | 1.624 | 1.654 | 1.551 | 1.766 | 2.083 | 0.173 | 0.156 |
| L174G | 0.184 | 0.087 | 0.210 | 0.230 | 0.026 | 0.031 |
| L174N | 1.616 | 2.276 | 2.494 | 2.872 | 0.331 | 0.543 |
| L174T | 0.552 | 0.566 | 0.689 | 0.820 | 0.090 | 0.050 |
| N178K | 2.931 | 4.375 | 4.891 | 4.513 | 0.258 | 0.362 |
| N178R | 8.160 | 13.820 | 16.287 | 20.033 | 0.665 | 0.790 |
| H193Q | 1.060 | 1.367 | 2.264 | 1.888 | 0.346 | 0.346 |
| K195T | 1.227 | 0.806 | 1.548 | 1.911 | 0.348 | 0.292 |
| K195N | 1.266 | 1.437 | 1.649 | 1.385 | 0.369 | 0.353 |
| K196E | 0.732 | 0.660 | 0.663 | 1.017 | 0.244 | 0.239 |
| K196R | 2.246 | 2.285 | 2.383 | 2.174 | 0.315 | 0.384 |
| F204P | 3.500 | 4.550 | 2.925 | 3.750 | 2.475 | 4.725 |
| N205A | 0.515 | 0.837 | 0.717 | 0.854 | 0.153 | 0.160 |
| N205E | 1.011 | 2.004 | 1.627 | 1.870 | 0.314 | 0.346 |
| N205L | 1.084 | 1.029 | 1.165 | 0.000 | 0.123 | 0.088 |
| N205T | 0.295 | 0.367 | 0.428 | 0.406 | 0.043 | 0.053 |
| V206I | 0.317 | 0.508 | 0.600 | 0.565 | 0.079 | 0.088 |
| K209R | 2.041 | 2.453 | 2.445 | 1.951 | 0.291 | 0.077 |
| D212N | 5.568 | 4.549 | 6.271 | 6.016 | 0.167 | 0.322 |
| D212S | 1.987 | 1.502 | 2.442 | 2.222 | 0.204 | 0.152 |
| D213A | 0.235 | 0.283 | 0.432 | 0.438 | 0.116 | 0.060 |
| D213M | 1.664 | 2.080 | 2.650 | 2.046 | 0.181 | 0.142 |
| S215H | 2.448 | 3.056 | 2.670 | 2.414 | 0.268 | 0.139 |
| S215M | 1.497 | 2.175 | 2.618 | 1.630 | 0.110 | 0.146 |
| N219I | 0.338 | 0.250 | 0.860 | 0.728 | 0.076 | 0.082 |
| E220V | 3.783 | 3.828 | 4.993 | 4.349 | 0.371 | 0.257 |
| T222G | 3.528 | 5.262 | 5.399 | 5.549 | 0.033 | 0.044 |
| T232F | 0.539 | 1.242 | 0.716 | 0.781 | 0.089 | 0.153 |
| Q233G | 0.041 | 0.095 | 0.115 | 0.121 | 0.000 | 0.000 |
| Q234M | 6.029 | 6.031 | 5.764 | 4.871 | 1.286 | 0.988 |
| S235A | 0.550 | 0.502 | 0.714 | 0.607 | 0.079 | 0.073 |
| V237C | 0.623 | 0.708 | 0.860 | 0.824 | 0.079 | 0.000 |
| V237H | 0.303 | 0.316 | 0.370 | 0.459 | 0.046 | 0.034 |
| V237T | 0.152 | 0.196 | 0.254 | 0.247 | 0.054 | 0.053 |
| A238E | 2.050 | 1.800 | 1.945 | 2.559 | 0.159 | 0.171 |

TABLE 11-continued

Absolute Hyaluronidase Activity

| Mutant | No incubation (4° C.) | | 37° C. no cresol (37° C.) | | 37° C. with m-cresol (37° C. plus m-cresol) | |
|---|---|---|---|---|---|---|
| A238H | 0.579 | 0.363 | 0.345 | 0.743 | 0.090 | 0.062 |
| T240A | 1.107 | 0.900 | 1.564 | 1.302 | 0.143 | 0.118 |
| T240Q | 0.333 | 0.510 | 0.542 | 0.617 | 0.080 | 0.085 |
| R248A | 2.274 | 2.499 | 2.575 | 3.115 | 0.027 | 0.075 |
| E249V | 3.001 | 3.894 | 4.284 | 4.325 | 0.655 | 0.712 |
| P257G | 3.981 | 4.452 | 4.985 | 5.022 | 0.039 | 0.034 |
| K260M | 0.719 | 0.960 | 0.839 | 0.935 | 0.072 | 0.068 |
| S261A | 3.253 | 3.117 | 1.872 | 2.686 | 1.264 | 1.451 |
| S261K | 6.089 | 5.421 | 9.860 | 6.297 | 1.583 | 1.437 |
| S261N | 14.149 | 40.257 | 20.219 | 14.303 | 2.115 | 1.917 |
| A267T | 0.052 | 0.095 | 0.102 | 0.106 | 0.036 | 0.041 |
| F273H | 0.340 | 0.436 | 0.417 | 0.519 | 0.025 | 0.031 |
| F273Y | 0.558 | 0.505 | 0.668 | 0.519 | 0.052 | 0.050 |
| Q276H | 2.706 | 1.877 | 2.027 | 1.997 | 0.181 | 0.201 |
| Q276M | 0.775 | 0.670 | 0.762 | 0.806 | 0.043 | 0.000 |
| Q276R | 6.080 | 9.717 | 7.383 | 14.593 | 0.807 | 1.281 |
| Q276S | 1.353 | 1.212 | 1.497 | 1.681 | 0.149 | 0.147 |
| V277A | 1.202 | 1.643 | 1.692 | 2.129 | 0.118 | 0.110 |
| V277E | 2.440 | 2.340 | 4.289 | 4.577 | 0.161 | 0.239 |
| V277H | 5.548 | 5.302 | 7.181 | 7.300 | 0.227 | 0.512 |
| V277K | 8.950 | 8.996 | 33.627 | 33.627 | 4.442 | 4.045 |
| V277M | 1.279 | 1.622 | 1.754 | 1.818 | 0.264 | 0.270 |
| V277N | 14.351 | 4.306 | 12.865 | 11.772 | 0.938 | 0.796 |
| V277Q | 5.459 | 5.461 | 6.547 | 6.343 | 0.373 | 0.493 |
| V277R | 18.300 | 12.038 | 17.581 | 20.641 | 2.737 | 2.023 |
| V277S | 14.351 | 10.444 | 9.509 | 15.135 | 0.727 | 0.716 |
| V277T | 8.412 | 7.804 | 8.497 | 11.184 | 0.679 | 0.871 |
| L278E | 4.416 | 2.795 | 3.330 | 2.800 | 0.170 | 0.202 |
| L278G | 7.502 | 7.456 | 9.173 | 7.760 | 0.596 | 0.612 |
| K279H | 0.888 | 1.087 | 1.234 | 1.339 | 0.185 | 0.269 |
| V287T | 0.580 | 0.667 | 0.843 | 0.832 | 0.139 | 0.100 |
| T289S | 0.783 | 1.019 | 0.819 | 1.001 | 0.008 | 0.007 |
| G291S | 0.227 | 0.322 | 0.419 | 0.385 | 0.051 | 0.016 |
| G291V | 3.662 | 3.707 | 4.131 | 5.599 | 0.821 | 0.706 |
| E292C | 1.344 | 1.599 | 1.711 | 1.617 | 0.138 | 0.144 |
| E292F | 6.106 | 4.697 | 8.422 | 6.216 | 0.520 | 0.363 |
| E292H | 2.620 | 3.316 | 4.458 | 3.830 | 0.389 | 0.451 |
| E292R | 2.810 | 2.178 | 3.155 | 2.829 | 0.398 | 0.339 |
| E292V | 0.891 | 1.121 | 1.453 | 1.494 | 0.193 | 0.177 |
| T293A | 1.986 | 3.110 | 2.546 | 1.789 | 0.086 | 0.076 |
| A298G | 0.161 | 0.274 | 0.342 | 0.236 | 0.030 | 0.022 |
| L307G | 0.616 | 0.661 | 0.726 | 0.605 | 0.000 | 0.000 |
| S308D | 0.264 | 0.325 | 0.337 | 0.344 | 0.014 | 0.010 |
| S308K | 0.651 | 0.722 | 0.826 | 0.716 | 0.011 | 0.000 |
| S308N | 3.995 | 4.406 | 6.808 | 6.128 | 0.386 | 0.362 |
| I309E | 3.166 | 2.819 | 3.921 | 3.663 | 0.637 | 0.528 |
| I309G | 6.651 | 5.429 | 6.824 | 6.194 | 0.503 | 0.400 |
| I309L | 0.326 | 0.403 | 0.501 | 0.431 | 0.048 | 0.047 |
| I309M | 2.809 | 2.473 | 3.467 | 3.383 | 0.278 | 0.239 |
| I309N | 4.865 | 5.191 | 5.444 | 5.054 | 0.380 | 0.327 |
| I309S | 10.719 | 28.759 | 18.217 | 158.604 | 0.748 | 1.367 |
| I309T | 3.052 | 2.509 | 2.989 | 3.735 | 0.228 | 0.207 |
| I309V | 1.705 | 1.292 | 1.929 | 1.787 | 0.029 | 0.062 |
| M310G | 4.514 | 6.397 | 7.568 | 7.084 | 0.866 | 0.915 |
| M310Q | 3.648 | 3.179 | 3.912 | 3.380 | 1.088 | 0.955 |
| M313G | 0.252 | 0.325 | 0.348 | 0.355 | 0.034 | 0.036 |
| M313H | 3.767 | 5.276 | 10.243 | 10.395 | 0.380 | 0.404 |
| M313K | 12.689 | 12.122 | 15.085 | 12.984 | 0.129 | 0.072 |
| M313P | 4.050 | 2.951 | 4.198 | 3.919 | 0.209 | 0.177 |
| M313R | 4.634 | 10.863 | 7.288 | 3.568 | 0.337 | 0.296 |
| M313T | 2.903 | 4.474 | 4.705 | 4.467 | 0.331 | 0.313 |
| M313Y | 1.063 | 1.262 | 1.276 | 1.300 | 0.096 | 0.089 |
| K314S | 2.848 | 4.450 | 4.042 | 5.879 | 0.391 | 0.533 |
| K314Y | 0.093 | 0.131 | 0.226 | 0.182 | 0.013 | 0.020 |
| S315A | 1.472 | 1.082 | 1.345 | 1.484 | 0.222 | 0.148 |
| S315H | 2.412 | 3.242 | 3.648 | 3.414 | 0.440 | 0.371 |
| S315Y | 0.279 | 0.626 | 0.477 | 0.362 | 0.146 | 0.143 |
| L317A | 3.254 | 2.845 | 4.019 | 3.776 | 0.280 | 0.317 |
| L317I | 1.078 | 1.524 | 2.021 | 1.687 | 0.257 | 0.180 |
| L317K | 12.129 | 9.382 | 11.668 | 12.591 | 0.402 | 0.445 |
| L317N | 2.907 | 3.066 | 3.703 | 3.717 | 0.445 | 0.540 |
| L317R | 8.631 | 15.187 | 20.585 | 15.106 | 0.796 | 0.857 |
| L317S | 11.586 | 29.267 | 10.535 | 25.114 | 1.637 | 1.613 |
| L317T | 1.338 | 1.073 | 1.953 | 1.656 | 0.136 | 0.018 |
| L317W | 0.810 | 1.128 | 1.326 | 1.665 | 0.158 | 0.171 |
| L318D | 1.750 | 1.970 | 1.847 | 1.930 | 0.322 | 0.322 |
| L318H | 1.073 | 0.806 | 1.072 | 1.005 | 0.046 | 0.074 |
| L318R | 2.856 | 3.464 | 4.583 | 4.187 | 0.258 | 0.260 |
| N321R | 3.069 | 4.409 | 5.059 | 4.946 | 0.482 | 0.426 |
| N321S | 0.683 | 0.710 | 0.700 | 0.772 | 0.058 | 0.035 |
| E324N | 4.309 | 2.530 | 4.508 | 3.321 | 0.348 | 0.303 |
| T325E | 1.071 | 1.270 | 1.337 | 1.352 | 0.193 | 0.143 |
| N328G | 0.379 | 0.504 | 0.747 | 0.553 | 0.031 | 0.040 |
| N328Y | 2.629 | 4.543 | 4.758 | 4.543 | 0.490 | 0.477 |
| T335S | 0.905 | 0.787 | 0.977 | 0.986 | 0.113 | 0.062 |
| Q347A | 8.316 | 11.961 | 8.432 | 11.508 | 0.918 | 1.266 |
| Q347G | 1.358 | 1.120 | 3.021 | 2.319 | 0.253 | 0.209 |
| Q349M | 1.493 | 1.629 | 1.486 | 1.760 | 0.178 | 0.217 |
| Q349R | 0.451 | 0.572 | 0.663 | 0.598 | 0.078 | 0.079 |
| V351S | 1.379 | 1.633 | 1.804 | 1.647 | 0.000 | 0.000 |
| I353V | 2.335 | 1.954 | 3.090 | 2.697 | 0.323 | 0.321 |
| N356H | 0.445 | 0.451 | 0.445 | 0.588 | 0.038 | 0.023 |
| N356S | 0.262 | 0.253 | 0.136 | 0.318 | 0.000 | 0.008 |
| S359E | 2.616 | 2.635 | 3.547 | 3.560 | 0.382 | 0.333 |
| S359H | 0.403 | 0.371 | 0.445 | 0.374 | 0.000 | 0.000 |
| P367A | 0.643 | 0.782 | 1.074 | 0.996 | 0.139 | 0.131 |
| P367G | 0.593 | 0.530 | 0.686 | 0.650 | 0.000 | 0.000 |
| P367K | 0.707 | 0.767 | 0.890 | 0.513 | 0.045 | 0.052 |
| P367S | 3.967 | 3.478 | 2.946 | 3.073 | 0.424 | 0.505 |
| D368A | 1.762 | 2.321 | 2.143 | 1.895 | 0.031 | 0.040 |
| D368E | 3.464 | 4.944 | 5.772 | 4.842 | 0.530 | 0.555 |
| D368L | 0.557 | 0.566 | 0.607 | 0.619 | 0.000 | 0.006 |
| D368M | 0.861 | 1.065 | 1.031 | 1.104 | 0.028 | 0.028 |
| D368R | 4.503 | 5.270 | 7.418 | 6.226 | 0.754 | 0.735 |
| D368T | 2.345 | 1.993 | 2.512 | 2.525 | 0.072 | 0.085 |
| N369R | 1.548 | 2.719 | 2.503 | 2.022 | 0.160 | 0.125 |
| A371F | 2.760 | 5.207 | 4.974 | 3.980 | 0.308 | 0.222 |
| A371H | 8.101 | 86.587 | 77.531 | 77.531 | 1.403 | 1.316 |
| A371H | 3.509 | 4.058 | 3.900 | 3.879 | 0.000 | 0.334 |
| A371K | 2.903 | 3.546 | 3.963 | 4.055 | 0.509 | 0.505 |
| A371L | 11.018 | 40.668 | 76.587 | 43.516 | 1.159 | 0.964 |
| A371L | 3.328 | 3.445 | 3.472 | 2.075 | 0.000 | 0.025 |
| A371R | 25.855 | 25.855 | n/a | n/a | 2.851 | 3.634 |
| A371R | 6.592 | 7.733 | 7.987 | 7.576 | 0.000 | 0.196 |
| A371S | 3.329 | 3.505 | 4.916 | 4.611 | 0.412 | 0.781 |
| L374P | 2.939 | 7.129 | 11.522 | 8.771 | 0.665 | 0.646 |
| E375A | 0.627 | 0.507 | 0.557 | 0.683 | 0.000 | 0.014 |
| E375G | 1.596 | 1.299 | 2.025 | 1.806 | 0.209 | 0.265 |
| E375R | 0.937 | 1.132 | 1.529 | 1.318 | 0.201 | 0.260 |
| K376D | 0.458 | 0.312 | 0.518 | 0.515 | 0.064 | 0.026 |
| K376E | 1.572 | 1.094 | 1.572 | 1.674 | 0.213 | 0.174 |
| K376Q | 0.727 | 0.940 | 0.910 | 0.846 | 0.116 | 0.102 |
| K376R | 2.086 | 1.351 | 1.704 | 2.690 | 0.539 | 0.279 |
| K376T | 0.847 | 1.001 | 1.026 | 1.135 | 0.153 | 0.064 |
| K376V | 0.834 | 0.861 | 1.036 | 1.021 | 0.033 | 0.026 |
| K376Y | 1.316 | 0.777 | 1.353 | 0.747 | 0.125 | 0.097 |
| G377D | 1.159 | 1.332 | 1.285 | 1.763 | 0.202 | 0.186 |
| G377E | 0.877 | 0.926 | 1.144 | 1.189 | 0.092 | 0.088 |
| G377H | 3.037 | 3.432 | 4.460 | 3.598 | 0.372 | 0.364 |
| G377K | 3.445 | 4.101 | 6.405 | 4.911 | 0.283 | 0.245 |
| G377R | 1.096 | 1.257 | 1.312 | 1.191 | 0.077 | 0.085 |
| G377S | 0.453 | 0.452 | 0.492 | 0.457 | 0.034 | 0.036 |
| G377T | 2.198 | 2.313 | 2.474 | 2.522 | 0.424 | 0.461 |
| F380W | 17.497 | 27.987 | 25.734 | 29.353 | 2.566 | 2.716 |
| T381S | 2.861 | 3.161 | 3.886 | 3.558 | 0.521 | 0.367 |
| R383I | 1.959 | 6.936 | 10.340 | 6.820 | 0.655 | 0.513 |
| R383S | 2.429 | 2.548 | 3.228 | 3.044 | 0.339 | 0.321 |
| K385A | 0.479 | 0.669 | 0.604 | 0.754 | 0.028 | 0.000 |
| K385Q | 1.746 | 2.089 | 2.403 | 2.609 | 0.217 | 0.196 |
| K385V | 1.232 | 1.750 | 1.387 | 1.410 | 0.071 | 0.042 |
| E389A | 6.872 | 10.944 | 21.081 | 24.610 | 0.449 | 0.449 |
| E389G | 0.166 | 0.203 | 0.188 | 0.284 | 0.004 | 0.000 |
| E389L | 1.814 | 2.142 | 2.598 | 2.403 | 0.370 | 0.303 |
| E389Q | 2.547 | 3.432 | 3.459 | 3.423 | 0.411 | 0.437 |
| E389S | 1.847 | 2.640 | 3.059 | 2.456 | 0.000 | 0.007 |
| E392A | 1.797 | 1.370 | 2.021 | 2.133 | 0.147 | 0.136 |
| E392F | 1.575 | 1.407 | 1.821 | 2.023 | 0.071 | 0.079 |
| E392Q | 5.826 | 4.653 | 6.583 | 4.364 | 0.693 | 0.729 |

TABLE 11-continued

Absolute Hyaluronidase Activity

| Mutant | No incubation (4° C.) | | 37° C. no cresol (37° C.) | | 37° C. with m-cresol (37° C. plus m-cresol) | |
|---|---|---|---|---|---|---|
| E392R | 4.555 | 5.306 | 5.900 | 6.548 | 0.218 | 0.193 |
| E392V | 3.817 | 2.936 | 4.747 | 4.544 | 0.367 | 0.291 |
| Q393F | 1.754 | 2.186 | 2.455 | 2.222 | 0.260 | 0.226 |
| Q393M | 1.252 | 1.826 | 1.749 | 1.588 | 0.028 | 0.049 |
| S395A | 4.220 | 6.127 | 8.788 | 6.906 | 1.141 | 0.856 |
| S395H | 1.609 | 2.261 | 2.574 | 2.564 | 0.323 | 0.268 |
| E396A | 1.135 | 1.184 | 1.497 | 1.524 | 0.126 | 0.149 |
| E396H | 0.357 | 0.532 | 0.751 | 0.684 | 0.069 | 0.022 |
| E396Q | 1.310 | 1.625 | 1.611 | 1.559 | 0.162 | 0.160 |
| E396S | 3.375 | 5.709 | 5.274 | 6.380 | 0.146 | 0.129 |
| Y399T | 2.538 | 3.250 | 3.313 | 3.989 | 0.000 | 0.002 |
| Y399V | 2.738 | 2.697 | 3.028 | 3.129 | 0.484 | 0.557 |
| Y399W | 1.400 | 1.883 | 1.715 | 1.946 | 0.236 | 0.233 |
| S401A | 2.636 | 3.171 | 3.216 | 3.148 | 0.447 | 0.410 |
| S401E | 1.685 | 1.601 | 2.110 | 2.060 | 0.344 | 0.309 |
| S404A | 1.288 | 1.635 | 1.924 | 1.724 | 0.000 | 0.019 |
| L406F | 0.706 | 0.490 | 0.867 | 0.716 | 0.000 | 0.000 |
| L406N | 0.617 | 0.795 | 0.943 | 1.044 | 0.060 | 0.070 |
| S407A | 2.428 | 2.949 | 3.432 | 3.255 | 0.389 | 0.548 |
| S407D | 2.090 | 5.790 | 5.038 | 5.682 | 0.569 | 0.575 |
| S407P | 2.660 | 2.708 | 3.812 | 3.301 | 0.261 | 0.366 |
| A412Q | 2.001 | 2.918 | 2.925 | 2.902 | 0.279 | 0.247 |
| A412R | 4.562 | 5.132 | 6.390 | 6.347 | 0.570 | 0.596 |
| A412V | 2.581 | 3.451 | 3.789 | 3.511 | 0.189 | 0.189 |
| D416L | 0.610 | 0.817 | 0.737 | 1.043 | 0.130 | 0.160 |
| D418R | 4.541 | 4.847 | 5.347 | 5.438 | 0.406 | 0.583 |
| A419H | 10.409 | 20.311 | 25.109 | 38.221 | 2.214 | 2.293 |
| A419K | 12.835 | 10.298 | 24.536 | 208.289 | 2.556 | 3.173 |
| D421A | 5.968 | 5.617 | 6.094 | 16.940 | 0.761 | 0.764 |
| D421H | 48.012 | 48.012 | 160.106 | 32.481 | 16.300 | 28.113 |
| D421K | 5.527 | 5.225 | 6.864 | 5.346 | 0.523 | 0.725 |
| D421N | 9.060 | 8.635 | 10.039 | 8.645 | 1.502 | 1.422 |
| D421Q | 7.529 | 5.581 | 7.858 | 8.016 | 0.842 | 0.994 |
| D421R | 6.637 | 5.463 | 9.211 | 7.537 | 0.815 | 0.737 |
| D421S | 5.556 | 5.355 | 7.899 | 8.898 | 0.869 | 0.762 |
| A425G | 10.421 | 8.827 | 7.796 | 10.676 | 0.827 | 1.189 |
| G427Q | 1.008 | 1.252 | 1.342 | 1.230 | 0.031 | 0.106 |
| G427T | 1.330 | 1.380 | 1.664 | 1.643 | 0.080 | 0.065 |
| V428L | 2.138 | 2.769 | 2.930 | 3.029 | 0.053 | 0.030 |
| D431E | 2.810 | 2.220 | 1.972 | 2.112 | 0.519 | 0.438 |
| D431H | 2.154 | 3.185 | 4.017 | 3.028 | 0.294 | 0.301 |
| D431K | 8.123 | 16.953 | 19.563 | 11.575 | 2.272 | 2.339 |
| D431L | 1.211 | 1.215 | 1.564 | 1.448 | 0.164 | 0.170 |
| D431N | 11.819 | 12.063 | 16.358 | 15.131 | 1.601 | 1.399 |
| D431Q | 6.077 | 9.828 | 14.157 | 10.760 | 1.533 | 1.153 |
| D431S | 14.523 | 10.220 | 11.338 | 9.075 | 0.853 | 0.829 |
| F433A | 4.035 | 4.673 | 5.943 | 4.649 | 0.581 | 0.595 |
| F433H | 1.836 | 2.397 | 2.574 | 2.108 | 0.347 | 0.356 |
| F433I | 2.754 | 2.643 | 2.990 | 2.299 | 0.338 | 0.382 |
| F433K | 17.815 | 14.495 | 16.240 | 49.615 | 1.806 | 1.790 |
| F433R | 8.198 | 6.719 | 10.572 | 8.960 | 1.113 | 0.857 |
| F433T | 6.005 | 5.941 | 9.716 | 8.019 | 1.327 | 1.542 |
| F433V | 10.645 | 7.762 | 150.315 | 8.696 | 2.415 | 1.505 |
| F433W | 0.526 | 0.795 | 0.784 | 0.903 | 0.082 | 0.068 |
| P437I | 0.759 | 0.996 | 1.130 | 1.066 | 0.027 | 0.019 |
| M438A | 1.996 | 1.518 | 2.125 | 2.060 | 0.214 | 0.210 |
| M438D | 2.849 | 2.522 | 3.002 | 2.857 | 0.305 | 0.074 |
| M438E | 4.681 | 4.992 | 5.386 | 5.680 | 0.431 | 0.518 |
| M438L | 10.127 | 5.268 | 6.663 | 11.324 | 0.670 | 0.739 |
| M438N | 6.172 | 5.531 | 8.050 | 5.568 | 0.649 | 0.662 |
| M438T | 2.218 | 2.411 | 2.308 | 2.500 | 0.309 | 0.304 |
| E439A | 3.557 | 4.432 | 4.883 | 4.235 | 0.568 | 0.596 |
| E439A | 1.099 | 0.998 | 1.694 | 1.470 | 0.080 | 0.109 |
| E439C | 0.148 | 0.256 | 0.286 | 0.286 | 0.042 | 0.045 |
| E439K | 0.466 | 0.588 | 0.580 | 0.616 | 0.077 | 0.065 |
| E439P | 2.868 | 3.736 | 3.394 | 3.267 | 0.529 | 0.490 |
| E439Q | 1.070 | 0.848 | 1.087 | 1.080 | 0.116 | 0.115 |
| E439T | 1.965 | 1.889 | 2.179 | 2.323 | 0.313 | 0.263 |
| T440D | 4.148 | 4.443 | 4.931 | 3.533 | 0.568 | 0.651 |
| T440H | 2.317 | 1.982 | 3.297 | 2.595 | 0.147 | 0.196 |
| T440M | 3.397 | 3.305 | 2.878 | 2.873 | 0.254 | 0.367 |
| T440P | 3.562 | 3.593 | 3.987 | 3.277 | 0.540 | 0.566 |
| T440S | 2.522 | 2.207 | 2.533 | 2.895 | 0.283 | 0.284 |
| E441F | 1.402 | 1.407 | 1.813 | 1.560 | 0.204 | 0.178 |
| E442G | 2.871 | 3.340 | 3.193 | 3.347 | 0.327 | 0.367 |
| P443E | 0.907 | 0.710 | 0.856 | 0.928 | 0.044 | 0.063 |
| P443F | 1.830 | 2.370 | 2.683 | 2.321 | 0.301 | 0.286 |
| P443G | 4.077 | 2.921 | 9.751 | 4.614 | 0.835 | 0.756 |
| Q444E | 8.293 | 3.861 | 6.800 | 6.213 | 0.581 | 0.594 |
| Q444H | 3.823 | 3.936 | 5.744 | 4.710 | 0.486 | 0.513 |
| Q444V | 2.193 | 2.107 | 2.847 | 2.583 | 0.384 | 0.284 |
| I445M | 5.265 | 4.438 | 4.480 | 4.489 | 0.773 | 0.691 |
| I445N | 3.375 | 4.024 | 3.592 | 3.515 | 0.499 | 0.455 |
| I445W | 2.289 | 2.694 | 2.683 | 2.695 | 0.314 | 0.296 |
| Y447E | 2.373 | 2.464 | 2.363 | 2.685 | 0.391 | 0.345 |
| Y447G | 0.945 | 1.352 | 1.358 | 1.401 | 0.187 | 0.162 |
| Y447P | 0.991 | 1.383 | 1.379 | 1.490 | 0.190 | 0.183 |
| positive control (OHO) | 2.919 | 2.173 | 2.773 | 2.105 | 0.145 | 0.178 |
| | 3.984 | 4.463 | 4.215 | 4.823 | 0.189 | 0.253 |
| | 3 | 2.725 | 3 | 3.325 | 0.1 | 0.125 |
| | 2.501 | 2.883 | 2.370 | 3.158 | 0.452 | 0.522 |
| | 7.629 | 2.989 | 10.835 | 3.914 | 0.485 | 0.219 |
| | 5.783 | 5.356 | 2.609 | 3.643 | 0.542 | 0.402 |
| | 5.279 | 5.422 | 2.815 | 4.026 | 0.618 | 0.401 |
| | 4.775 | 4.385 | 2.845 | 3.327 | 0.718 | 0.540 |
| | 3.617 | 4.264 | 3.322 | 3.427 | 0.633 | 0.479 |
| | 5.881 | 4.511 | 5.518 | 4.359 | 0.743 | 0.848 |
| | 6.754 | 4.932 | 3.902 | 4.120 | 0.665 | 0.724 |
| | 3.911 | 3.494 | 3.911 | 5.179 | 0.726 | 0.841 |
| | 5.406 | 7.559 | 4.018 | 4.620 | 0.735 | 0.429 |
| | 4.015 | 3.887 | 3.9400 | 3.4080 | 0.3340 | 0.3410 |
| | 2.604 | 2.339 | 2.4430 | 2.3910 | 0.2350 | 0.2330 |
| | 3.736 | 3.473 | 3.6210 | 3.0560 | 0.3100 | 0.2770 |
| | 3.759 | 3.509 | 3.6330 | 3.0490 | 0.3600 | 0.3030 | n/a (not available; e.g., beyond detection limit)

TABLE 12

Percent (%) Activity

| | duplicate 1 | | | duplicate 2 | | |
|---|---|---|---|---|---|---|
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| L001A | 117.908 | 8.13 | 9.59 | 127.997 | 9.179 | 11.75 |
| L001E | 107.231 | 13.14 | 14.09 | 125.207 | 10.727 | 13.43 |
| L001G | 171.264 | 9.23 | 15.80 | 115.952 | 4.586 | 5.32 |
| L001Q | 119.435 | 10.13 | 12.09 | 88.763 | 11.121 | 9.87 |
| L001R | 117.366 | 6.96 | 8.17 | 160.410 | 5.623 | 9.02 |
| P006A | 137.875 | 9.88 | 13.63 | 108.946 | 12.446 | 13.56 |
| V008M | 134.884 | 0.00 | 0.00 | 119.772 | 0.477 | 0.57 |
| I009Q | 104.922 | 6.61 | 6.94 | 124.934 | 6.303 | 7.87 |

TABLE 12-continued

| | Percent (%) Activity | | | | | |
|---|---|---|---|---|---|---|
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| P010G | 109.772 | 15.00 | 16.47 | 121.986 | 16.570 | 20.21 |
| P010H | 131.924 | 0.00 | 0.00 | 112.990 | 0.000 | 0.00 |
| N011S | 152.320 | 7.16 | 10.90 | 131.289 | 5.067 | 6.65 |
| V012E | 48.208 | 14.18 | 6.83 | 100.163 | 16.896 | 16.92 |
| V012I | 128.745 | 2.94 | 3.78 | 170.812 | 1.371 | 2.34 |
| V012K | 146.600 | 13.31 | 19.52 | 114.264 | 14.311 | 16.35 |
| F014V | 154.167 | 1.35 | 2.08 | 146.667 | 0.000 | 0.00 |
| L015M | 113.747 | 1.66 | 1.88 | 83.970 | 1.887 | 1.58 |
| A020S | 188.889 | 14.64 | 27.64 | 118.821 | 15.153 | 18.00 |
| S022T | 111.203 | 20.27 | 22.54 | 86.404 | 22.854 | 19.75 |
| L026M | 136.775 | 11.05 | 15.11 | 138.989 | 10.446 | 14.52 |
| K028R | 110.487 | 10.74 | 11.86 | 109.467 | 10.270 | 11.24 |
| F029R | 154.644 | 7.58 | 11.72 | 121.707 | 7.613 | 9.27 |
| F029S | 118.119 | 7.01 | 8.28 | 97.400 | 8.037 | 7.83 |
| F029T | 126.740 | 11.96 | 15.16 | 120.619 | 10.266 | 12.38 |
| P032C | 128.649 | 1.26 | 1.62 | 127.446 | 7.491 | 9.55 |
| L033G | 121.201 | 0.15 | 0.18 | 89.571 | 4.147 | 3.71 |
| D034W | 146.765 | 15.23 | 22.35 | 146.729 | 14.650 | 21.50 |
| M035V | 81.285 | 16.09 | 13.08 | 102.034 | 3.528 | 3.60 |
| S036H | 106.222 | 9.93 | 10.55 | 150.931 | 2.291 | 3.46 |
| S036N | 112.045 | 19.15 | 21.46 | 92.069 | 30.268 | 27.87 |
| L037M | 79.268 | 10.77 | 8.54 | 87.376 | 9.065 | 7.92 |
| F040L | 135.036 | 7.88 | 10.64 | 105.252 | 8.703 | 9.16 |
| I046L | 132.507 | 12.79 | 16.95 | 112.944 | 16.667 | 18.82 |
| N047D | 115.797 | 1.24 | 1.44 | 111.869 | 0.796 | 0.89 |
| N047W | 104.703 | 0.00 | 0.00 | 109.880 | 3.728 | 4.10 |
| A048N | 114.954 | 5.59 | 6.43 | 51.931 | 3.778 | 1.96 |
| T049R | 122.704 | 5.81 | 7.13 | 90.760 | 5.363 | 4.87 |
| G050D | 93.824 | 7.85 | 7.36 | 95.934 | 8.742 | 8.39 |
| G050M | 157.686 | 8.99 | 14.18 | 139.048 | 12.115 | 16.85 |
| G052N | 96.148 | 15.98 | 15.37 | 142.502 | 7.748 | 11.04 |
| G052T | 116.407 | 21.23 | 24.71 | 117.075 | 32.310 | 37.83 |
| G052S | 98.513 | 23.49 | 23.14 | 98.199 | 28.833 | 28.31 |
| V058C | 92.507 | 16.05 | 14.85 | 99.162 | 16.141 | 16.01 |
| V058K | 217.914 | 38.66 | 84.24 | 217.914 | 38.655 | 84.24 |
| V058R | 96.905 | 56.55 | 54.80 | 102.858 | 65.305 | 67.17 |
| V058N | 129.167 | 12.90 | 16.67 | 129.787 | 11.475 | 14.89 |
| V058Y | 102.981 | 36.23 | 37.31 | 141.299 | 41.728 | 58.96 |
| V058Q | 154.383 | 8.49 | 13.11 | 293.510 | 4.804 | 14.10 |
| V058P | 83.304 | 21.15 | 17.62 | 173.652 | 17.262 | 29.98 |
| V058H | 200.264 | 10.88 | 21.79 | 181.750 | 13.067 | 23.75 |
| D068P | 99.070 | 0.47 | 0.47 | 83.721 | 102.222 | 85.58 |
| S069T | 138.609 | 10.82 | 15.00 | 122.579 | 8.985 | 11.01 |
| I070P | 101.713 | 0.77 | 0.78 | 99.749 | 2.014 | 2.01 |
| I070V | 170.462 | 13.97 | 23.82 | 136.849 | 10.885 | 14.90 |
| V073Q | 121.337 | 6.51 | 7.90 | 107.094 | 8.186 | 8.77 |
| V073R | 137.931 | 2.50 | 3.45 | 100.125 | 7.338 | 7.35 |
| T074E | 133.241 | 17.22 | 22.94 | 100.965 | 16.172 | 16.33 |
| T074M | 115.290 | 12.04 | 13.88 | 103.629 | 10.765 | 11.16 |
| T074N | 91.870 | 10.96 | 10.06 | 157.218 | 6.811 | 10.71 |
| T074P | 108.323 | 12.24 | 13.26 | 166.227 | 10.008 | 16.64 |
| T074R | 80.681 | 7.44 | 6.01 | 130.000 | 2.158 | 2.80 |
| T074V | 115.093 | 7.40 | 8.52 | 114.063 | 5.479 | 6.25 |
| V075M | 134.460 | 0.24 | 0.33 | 121.527 | 2.120 | 2.58 |
| K082L | 114.758 | 20.79 | 23.86 | 251.869 | 10.721 | 27.00 |
| K082N | 106.059 | 23.32 | 24.73 | 95.104 | 26.541 | 25.24 |
| I083V | 140.151 | 29.88 | 41.88 | 137.296 | 28.133 | 38.63 |
| I083Q | 112.163 | 27.02 | 30.30 | 188.798 | 13.881 | 26.21 |
| I083S | 104.637 | 26.70 | 27.94 | 95.351 | 26.667 | 25.43 |
| I083G | 106.239 | 22.54 | 23.95 | 76.381 | 32.208 | 24.60 |
| S084E | 124.762 | 6.27 | 7.82 | 113.410 | 6.833 | 7.75 |
| S084F | 83.291 | 2.55 | 2.12 | 91.007 | 0.000 | 0.00 |
| S084N | 144.922 | 18.27 | 26.47 | 131.144 | 22.092 | 28.97 |
| S084R | 119.873 | 10.92 | 13.09 | 203.099 | 4.977 | 10.11 |
| Q086A | 136.516 | 14.24 | 19.43 | 156.132 | 9.728 | 15.19 |
| Q086H | 102.612 | 7.14 | 7.33 | 129.600 | 5.015 | 6.50 |
| Q086K | 99.213 | 25.40 | 25.20 | 65.455 | 31.944 | 20.91 |
| Q086S | 100.435 | 6.81 | 6.84 | 103.218 | 11.215 | 11.58 |
| Q086T | 93.837 | 10.24 | 9.61 | 179.465 | 8.900 | 15.97 |
| D087G | 81.742 | 1.51 | 1.23 | 90.579 | 6.190 | 5.61 |
| D087L | 106.039 | 14.76 | 15.65 | 101.493 | 12.938 | 13.13 |
| D087M | 110.964 | 7.61 | 8.44 | 87.656 | 16.438 | 14.41 |

TABLE 12-continued

| | Percent (%) Activity | | | | | |
|---|---|---|---|---|---|---|
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| D087S | 134.031 | 8.15 | 10.92 | 139.728 | 6.445 | 9.01 |
| D087V | 114.107 | 9.14 | 10.43 | 87.023 | 15.922 | 13.86 |
| D090E | 92.910 | 14.26 | 13.25 | 161.281 | 6.221 | 10.03 |
| D090N | 111.060 | 12.14 | 13.48 | 98.631 | 10.596 | 10.45 |
| K093Q | 91.008 | 5.82 | 5.30 | 95.448 | 6.646 | 6.34 |
| K093R | 103.617 | 11.70 | 12.12 | 99.301 | 16.362 | 16.25 |
| K094D | 86.544 | 6.52 | 5.64 | 102.107 | 9.897 | 10.11 |
| K094R | 125.373 | 8.96 | 11.23 | 108.690 | 9.905 | 10.77 |
| T097C | 165.152 | 8.07 | 13.33 | 81.715 | 17.228 | 14.08 |
| T097D | 123.654 | 8.55 | 10.58 | 117.522 | 10.994 | 12.92 |
| T097E | 127.190 | 15.57 | 19.80 | 115.106 | 16.143 | 18.58 |
| T097L | 118.465 | 23.10 | 27.36 | 103.589 | 24.174 | 25.04 |
| N104R | 114.673 | 9.70 | 11.12 | 118.421 | 8.530 | 10.10 |
| A120H | 94.107 | 8.28 | 7.80 | 113.015 | 6.903 | 7.80 |
| D127R | 56.439 | 70.47 | 39.77 | 58.702 | 34.171 | 20.06 |
| V128I | 113.654 | 10.97 | 12.47 | 102.656 | 14.819 | 15.21 |
| N131M | 177.000 | 1.86 | 3.29 | 76.888 | 2.811 | 2.16 |
| N131R | 94.253 | 21.30 | 20.07 | 95.930 | 19.376 | 18.59 |
| N131V | 137.681 | 10.22 | 14.07 | 104.920 | 10.907 | 11.44 |
| R132L | 98.578 | 10.34 | 10.19 | 91.685 | 14.498 | 13.29 |
| Q138L | 107.831 | 25.45 | 27.44 | 91.627 | 22.814 | 20.90 |
| Q140K | 176.600 | 10.93 | 19.30 | 109.815 | 12.522 | 13.75 |
| N141R | 103.411 | 4.35 | 4.50 | 115.682 | 2.292 | 2.65 |
| N141S | 131.758 | 4.66 | 6.13 | 109.527 | 5.529 | 6.06 |
| N141W | 130.644 | 5.19 | 6.78 | 104.783 | 6.391 | 6.70 |
| V142D | 114.185 | 4.39 | 5.02 | 146.066 | 2.098 | 3.06 |
| V142G | 117.686 | 13.21 | 15.55 | 90.256 | 13.510 | 12.19 |
| V142K | 109.485 | 14.77 | 16.17 | 154.599 | 15.621 | 24.15 |
| V142N | 155.556 | 15.33 | 23.84 | 103.880 | 14.771 | 15.34 |
| V142P | 166.998 | 13.91 | 23.23 | 97.338 | 15.397 | 14.99 |
| V142Q | 149.666 | 8.90 | 13.32 | 99.957 | 9.830 | 9.83 |
| V142R | 149.441 | 12.38 | 18.50 | 103.622 | 12.272 | 12.72 |
| V142S | 170.778 | 8.73 | 14.92 | 117.035 | 16.900 | 19.78 |
| V142T | 223.936 | 11.48 | 25.70 | 123.650 | 11.709 | 14.48 |
| Q143G | 143.600 | 13.88 | 19.94 | 98.837 | 16.096 | 15.91 |
| Q143K | 200.468 | 14.32 | 28.70 | 136.421 | 20.747 | 28.30 |
| L144R | 136.247 | 10.71 | 14.59 | 111.482 | 10.182 | 11.35 |
| L144T | 129.746 | 14.68 | 19.05 | 108.923 | 11.961 | 13.03 |
| L146P | 116.626 | 1.15 | 1.34 | 115.601 | 3.429 | 3.96 |
| T147S | 142.175 | 3.93 | 5.59 | 130.287 | 2.605 | 3.39 |
| T150N | 140.724 | 6.27 | 8.82 | 116.923 | 6.725 | 7.86 |
| T150S | 107.327 | 6.40 | 6.87 | 142.000 | 6.087 | 8.64 |
| E151A | 103.310 | 12.11 | 12.51 | 126.047 | 11.783 | 14.85 |
| E151L | 132.125 | 4.90 | 6.48 | 121.830 | 6.264 | 7.63 |
| E151S | 115.423 | 6.20 | 7.15 | 136.397 | 4.695 | 6.40 |
| E151T | 128.337 | 0.00 | 0.00 | 110.300 | 0.000 | 0.00 |
| E151V | 111.531 | 7.31 | 8.15 | 99.647 | 7.420 | 7.39 |
| E151W | 158.415 | 1.15 | 1.83 | 94.919 | 0.895 | 0.85 |
| K152T | 149.169 | 5.57 | 8.31 | 136.747 | 3.558 | 4.87 |
| K152W | 122.313 | 2.47 | 3.02 | 134.039 | 2.868 | 3.84 |
| E158S | 133.038 | 0.00 | 0.00 | 102.519 | 0.000 | 0.00 |
| K162E | 67.857 | 3.51 | 2.38 | 41.026 | 30.000 | 12.31 |
| L165F | 106.283 | 11.82 | 12.57 | 96.667 | 14.286 | 13.81 |
| V166Q | 155.975 | 13.35 | 20.82 | 117.990 | 10.953 | 12.92 |
| V166T | 183.384 | 12.69 | 23.26 | 136.882 | 13.056 | 17.87 |
| E167D | 136.745 | 10.01 | 13.69 | 162.637 | 3.784 | 6.15 |
| I169L | 140.177 | 13.19 | 18.49 | 122.272 | 15.528 | 18.99 |
| K170R | 160.710 | 8.24 | 13.24 | 97.128 | 10.075 | 9.79 |
| G172A | 167.554 | 7.51 | 12.59 | 133.735 | 7.207 | 9.64 |
| K173R | 106.771 | 9.80 | 10.46 | 134.300 | 7.489 | 10.06 |
| L174G | 114.130 | 12.38 | 14.13 | 264.368 | 13.478 | 35.63 |
| L174N | 154.332 | 13.27 | 20.48 | 126.186 | 18.907 | 23.86 |
| L174T | 124.819 | 13.06 | 16.30 | 144.876 | 6.098 | 8.83 |
| N178K | 166.871 | 5.27 | 8.80 | 103.154 | 8.021 | 8.27 |
| N178R | 199.596 | 4.08 | 8.15 | 144.957 | 3.943 | 5.72 |
| H193Q | 213.585 | 15.28 | 32.64 | 138.113 | 18.326 | 25.31 |
| K195T | 126.161 | 22.48 | 28.36 | 237.097 | 15.280 | 36.23 |
| K195N | 130.253 | 22.38 | 29.15 | 96.381 | 25.487 | 24.57 |
| K196E | 90.574 | 36.80 | 33.33 | 154.091 | 23.500 | 36.21 |
| K196R | 106.100 | 13.22 | 14.02 | 95.142 | 17.663 | 16.81 |
| F204P | 83.571 | 84.62 | 70.71 | 82.418 | 126.000 | 103.85 |
| N205A | 139.223 | 21.34 | 29.71 | 102.031 | 18.735 | 19.12 |

TABLE 12-continued

| | Percent (%) Activity | | | | | |
|---|---|---|---|---|---|---|
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| N205E | 160.930 | 19.30 | 31.06 | 93.313 | 18.503 | 17.27 |
| N205L | 107.472 | 10.56 | 11.35 | 0.000 | #DIV/0! | 8.55 |
| N205T | 145.085 | 10.05 | 14.58 | 110.627 | 13.054 | 14.44 |
| V206I | 189.274 | 13.17 | 24.92 | 111.220 | 15.575 | 17.32 |
| K209R | 119.794 | 11.90 | 14.26 | 79.535 | 3.947 | 3.14 |
| D212N | 112.626 | 2.66 | 3.00 | 132.249 | 5.352 | 7.08 |
| D212S | 122.899 | 8.35 | 10.27 | 147.936 | 6.841 | 10.12 |
| D213A | 183.830 | 26.85 | 49.36 | 154.770 | 13.699 | 21.20 |
| D213M | 159.255 | 6.83 | 10.88 | 98.365 | 6.940 | 6.83 |
| S215H | 109.069 | 10.04 | 10.95 | 78.992 | 5.758 | 4.55 |
| S215M | 174.883 | 4.20 | 7.35 | 74.943 | 8.957 | 6.71 |
| N219I | 254.438 | 8.84 | 22.49 | 291.200 | 11.264 | 32.80 |
| E220V | 131.985 | 7.43 | 9.81 | 113.610 | 5.909 | 6.71 |
| T222G | 153.033 | 0.61 | 0.94 | 105.454 | 0.793 | 0.84 |
| T232F | 132.839 | 12.43 | 16.51 | 62.882 | 19.590 | 12.32 |
| Q233G | 280.488 | 0.00 | 0.00 | 127.368 | 0.000 | 0.00 |
| Q234M | 95.605 | 22.31 | 21.33 | 80.766 | 20.283 | 16.38 |
| S235A | 129.818 | 11.06 | 14.36 | 120.916 | 12.026 | 14.54 |
| V237C | 138.042 | 0.00 | 0.00 | 116.384 | 0.000 | 0.00 |
| V237H | 122.112 | 12.43 | 15.18 | 145.253 | 7.407 | 10.76 |
| V237T | 167.105 | 21.26 | 35.53 | 126.020 | 21.457 | 27.04 |
| A238E | 94.878 | 8.17 | 7.76 | 142.167 | 6.682 | 9.50 |
| A238H | 59.585 | 26.09 | 15.54 | 204.683 | 8.345 | 17.08 |
| T240A | 141.283 | 9.14 | 12.92 | 144.667 | 9.063 | 13.11 |
| T240Q | 162.763 | 14.76 | 24.02 | 120.980 | 13.776 | 16.67 |
| R248A | 113.237 | 1.05 | 1.19 | 124.650 | 2.408 | 3.00 |
| E249V | 142.752 | 15.29 | 21.83 | 111.068 | 16.462 | 18.28 |
| P257G | 125.220 | 0.78 | 0.98 | 112.803 | 0.677 | 0.76 |
| K260M | 116.690 | 8.58 | 10.01 | 97.396 | 7.273 | 7.08 |
| S261A | 57.547 | 67.52 | 38.86 | 86.173 | 54.021 | 46.55 |
| S261K | 161.931 | 16.05 | 26.00 | 116.159 | 22.820 | 26.51 |
| S261N | 142.901 | 10.46 | 14.95 | 35.529 | 13.403 | 4.76 |
| A267T | 196.154 | 35.29 | 69.23 | 111.579 | 38.679 | 43.16 |
| F273H | 122.647 | 6.00 | 7.35 | 119.037 | 5.973 | 7.11 |
| F273Y | 119.713 | 7.78 | 9.32 | 102.772 | 9.634 | 9.90 |
| Q276H | 74.908 | 8.93 | 6.69 | 106.393 | 10.065 | 10.71 |
| Q276M | 98.323 | 5.64 | 5.55 | 104.948 | 0.000 | 0.00 |
| Q276R | 121.431 | 10.93 | 13.27 | 150.180 | 8.778 | 13.18 |
| Q276S | 110.643 | 9.95 | 11.01 | 138.696 | 8.745 | 12.13 |
| V277A | 140.765 | 6.97 | 9.82 | 129.580 | 5.167 | 6.70 |
| V277E | 175.779 | 3.75 | 6.60 | 195.598 | 5.222 | 10.21 |
| V277H | 129.434 | 3.16 | 4.09 | 137.684 | 7.014 | 9.66 |
| V277K | 375.721 | 13.21 | 49.63 | 373.799 | 12.029 | 44.96 |
| V277M | 137.138 | 15.05 | 20.64 | 112.084 | 14.851 | 16.65 |
| V277N | 89.645 | 7.29 | 6.54 | 273.386 | 6.762 | 18.49 |
| V277Q | 119.930 | 5.70 | 6.83 | 116.151 | 7.772 | 9.03 |
| V277R | 96.071 | 15.57 | 14.96 | 171.465 | 9.801 | 16.81 |
| V277S | 66.260 | 7.65 | 5.07 | 144.916 | 4.731 | 6.86 |
| V277T | 101.010 | 7.99 | 8.07 | 143.311 | 7.788 | 11.16 |
| L278E | 75.408 | 5.11 | 3.85 | 100.179 | 7.214 | 7.23 |
| L278G | 122.274 | 6.50 | 7.94 | 104.077 | 7.887 | 8.21 |
| K279H | 138.964 | 14.99 | 20.83 | 123.183 | 20.090 | 24.75 |
| V287T | 145.345 | 16.49 | 23.97 | 124.738 | 12.019 | 14.99 |
| T289S | 104.598 | 0.98 | 1.02 | 98.234 | 0.699 | 0.69 |
| G291S | 184.581 | 12.17 | 22.47 | 119.565 | 4.156 | 4.97 |
| G291V | 112.807 | 19.87 | 22.42 | 151.039 | 12.609 | 19.05 |
| E292C | 127.307 | 8.07 | 10.27 | 101.126 | 8.905 | 9.01 |
| E292F | 137.930 | 6.17 | 8.52 | 132.340 | 5.840 | 7.73 |
| E292H | 170.153 | 8.73 | 14.85 | 115.501 | 11.775 | 13.60 |
| E292R | 112.278 | 12.61 | 14.16 | 129.890 | 11.983 | 15.56 |
| E292V | 163.075 | 13.28 | 21.66 | 133.274 | 11.847 | 15.79 |
| T293A | 128.197 | 3.38 | 4.33 | 57.524 | 4.248 | 2.44 |
| A298G | 212.422 | 8.77 | 18.63 | 86.131 | 9.322 | 8.03 |
| L307G | 117.857 | 0.00 | 0.00 | 91.528 | 0.000 | 0.00 |
| S308D | 127.652 | 4.15 | 5.30 | 105.846 | 2.907 | 3.08 |
| S308K | 126.882 | 1.33 | 1.69 | 99.169 | 0.000 | 0.00 |
| S308N | 170.413 | 5.67 | 9.66 | 139.083 | 5.907 | 8.22 |
| I309E | 123.847 | 16.25 | 20.12 | 129.940 | 14.414 | 18.73 |
| I309G | 102.601 | 7.37 | 7.56 | 114.091 | 6.458 | 7.37 |
| I309L | 153.681 | 9.58 | 14.72 | 106.948 | 10.905 | 11.66 |
| I309M | 123.425 | 8.02 | 9.90 | 136.797 | 7.065 | 9.66 |
| I309N | 111.901 | 6.98 | 7.81 | 97.361 | 6.470 | 6.30 |

TABLE 12-continued

| | Percent (%) Activity | | | | | |
|---|---|---|---|---|---|---|
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| I309S | 169.951 | 4.11 | 6.98 | 551.493 | 0.862 | 4.75 |
| I309T | 97.936 | 7.63 | 7.47 | 148.864 | 5.542 | 8.25 |
| I309V | 113.138 | 1.50 | 1.70 | 138.313 | 3.470 | 4.80 |
| M310G | 167.656 | 11.44 | 19.18 | 110.739 | 12.916 | 14.30 |
| M310Q | 107.237 | 27.81 | 29.82 | 106.323 | 28.254 | 30.04 |
| M313G | 138.095 | 9.77 | 13.49 | 109.231 | 10.141 | 11.08 |
| M313H | 271.914 | 3.71 | 10.09 | 197.024 | 3.886 | 7.66 |
| M313K | 118.882 | 0.86 | 1.02 | 107.111 | 0.555 | 0.59 |
| M313P | 103.654 | 4.98 | 5.16 | 132.802 | 4.516 | 6.00 |
| M313R | 157.272 | 4.62 | 7.27 | 32.845 | 8.296 | 2.72 |
| M313T | 162.074 | 7.04 | 11.40 | 99.844 | 7.007 | 7.00 |
| M313Y | 120.038 | 7.52 | 9.03 | 103.011 | 6.846 | 7.05 |
| K314S | 141.924 | 9.67 | 13.73 | 132.112 | 9.066 | 11.98 |
| K314Y | 243.011 | 5.75 | 13.98 | 138.931 | 10.989 | 15.27 |
| S315A | 91.372 | 16.51 | 15.08 | 137.153 | 9.973 | 13.68 |
| S315H | 151.244 | 12.06 | 18.24 | 105.305 | 10.867 | 11.44 |
| S315Y | 170.968 | 30.61 | 52.33 | 57.827 | 39.503 | 22.84 |
| L317A | 123.510 | 6.97 | 8.60 | 132.724 | 8.395 | 11.14 |
| L317I | 187.477 | 12.72 | 23.84 | 110.696 | 10.670 | 11.81 |
| L317K | 96.199 | 3.45 | 3.31 | 134.204 | 3.534 | 4.74 |
| L317N | 127.382 | 12.02 | 15.31 | 121.233 | 14.528 | 17.61 |
| L317R | 238.501 | 3.87 | 9.22 | 99.467 | 5.673 | 5.64 |
| L317S | 90.929 | 15.54 | 14.13 | 85.810 | 6.423 | 5.51 |
| L317T | 145.964 | 6.96 | 10.16 | 154.334 | 1.087 | 1.68 |
| L317W | 163.704 | 11.92 | 19.51 | 147.606 | 10.270 | 15.16 |
| L318D | 105.543 | 17.43 | 18.40 | 97.970 | 16.684 | 16.35 |
| L318H | 99.907 | 4.29 | 4.29 | 124.690 | 7.363 | 9.18 |
| L318R | 160.469 | 5.63 | 9.03 | 120.872 | 6.210 | 7.51 |
| N321R | 164.842 | 9.53 | 15.71 | 112.180 | 8.613 | 9.66 |
| N321S | 102.489 | 8.29 | 8.49 | 108.732 | 4.534 | 4.93 |
| E324N | 104.618 | 7.72 | 8.08 | 131.265 | 9.124 | 11.98 |
| T325E | 124.837 | 14.44 | 18.02 | 106.457 | 10.577 | 11.26 |
| N328G | 197.098 | 4.15 | 8.18 | 109.722 | 7.233 | 7.94 |
| N328Y | 180.981 | 10.30 | 18.64 | 100.000 | 10.500 | 10.50 |
| T335S | 107.956 | 11.57 | 12.49 | 125.286 | 6.288 | 7.88 |
| Q347A | 101.395 | 10.89 | 11.04 | 96.213 | 11.001 | 10.58 |
| Q347G | 222.459 | 8.37 | 18.63 | 207.054 | 9.013 | 18.66 |
| Q349M | 99.531 | 11.98 | 11.92 | 108.042 | 12.330 | 13.32 |
| Q349R | 147.007 | 11.76 | 17.29 | 104.545 | 13.211 | 13.81 |
| V351S | 130.819 | 0.00 | 0.00 | 100.857 | 0.000 | 0.00 |
| I353V | 132.334 | 10.45 | 13.83 | 138.025 | 11.902 | 16.43 |
| N356H | 100.000 | 8.54 | 8.54 | 130.377 | 3.912 | 5.10 |
| N356S | 51.908 | 0.00 | 0.00 | 125.692 | 2.516 | 3.16 |
| S359E | 135.589 | 10.77 | 14.60 | 135.104 | 9.354 | 12.64 |
| S359H | 110.422 | 0.00 | 0.00 | 100.809 | 0.000 | 0.00 |
| P367A | 167.030 | 12.94 | 21.62 | 127.366 | 13.153 | 16.75 |
| P367G | 115.683 | 0.00 | 0.00 | 122.642 | 0.000 | 0.00 |
| P367K | 125.884 | 5.06 | 6.36 | 66.884 | 10.136 | 6.78 |
| P367S | 74.263 | 14.39 | 10.69 | 88.355 | 16.433 | 14.52 |
| D368A | 121.623 | 1.45 | 1.76 | 81.646 | 2.111 | 1.72 |
| D368E | 166.628 | 9.18 | 15.30 | 97.937 | 11.462 | 11.23 |
| D368L | 108.977 | 0.00 | 0.00 | 109.364 | 0.969 | 1.06 |
| D368M | 119.744 | 2.72 | 3.25 | 103.662 | 2.536 | 2.63 |
| D368R | 164.735 | 10.16 | 16.74 | 118.140 | 11.805 | 13.95 |
| D368T | 107.122 | 2.87 | 3.07 | 126.693 | 3.366 | 4.26 |
| N369R | 161.693 | 6.39 | 10.34 | 74.366 | 6.182 | 4.60 |
| A371F | 180.217 | 6.19 | 11.16 | 76.436 | 5.578 | 4.26 |
| A371H | 957.055 | 1.81 | 17.32 | 89.541 | 1.697 | 1.52 |
| A371H | 111.143 | 0.00 | 0.00 | 95.589 | 8.610 | 8.23 |
| A371K | 136.514 | 12.84 | 17.53 | 114.354 | 12.454 | 14.24 |
| A371L | 695.108 | 1.51 | 10.52 | 107.003 | 2.215 | 2.37 |
| A371L | 104.327 | 0.00 | 0.00 | 60.232 | 1.205 | 0.73 |
| A371R | #VALUE! | #VALUE! | 11.03 | #VALUE! | #VALUE! | 14.06 |
| A371R | 121.162 | 0.00 | 0.00 | 97.970 | 2.587 | 2.53 |
| A371S | 147.672 | 8.38 | 12.38 | 131.555 | 16.938 | 22.28 |
| L374P | 392.038 | 5.77 | 22.63 | 123.033 | 7.365 | 9.06 |
| E375A | 88.836 | 0.00 | 0.00 | 134.714 | 2.050 | 2.76 |
| E375G | 126.880 | 10.32 | 13.10 | 139.030 | 14.673 | 20.40 |
| E375R | 163.180 | 13.15 | 21.45 | 116.431 | 19.727 | 22.97 |
| K376D | 113.100 | 12.36 | 13.97 | 165.064 | 5.049 | 8.33 |
| K376E | 100.000 | 13.55 | 13.55 | 153.016 | 10.394 | 15.90 |
| K376Q | 125.172 | 12.75 | 15.96 | 90.000 | 12.057 | 10.85 |

TABLE 12-continued

| | Percent (%) Activity | | | | | |
| --- | --- | --- | --- | --- | --- | --- |
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| K376R | 81.687 | 31.63 | 25.84 | 199.112 | 10.372 | 20.65 |
| K376T | 121.133 | 14.91 | 18.06 | 113.387 | 5.639 | 6.39 |
| K376V | 124.221 | 3.19 | 3.96 | 118.583 | 2.547 | 3.02 |
| K376Y | 102.812 | 9.24 | 9.50 | 96.139 | 12.985 | 12.48 |
| G377D | 110.871 | 15.72 | 17.43 | 132.357 | 10.550 | 13.96 |
| G377E | 130.445 | 8.04 | 10.49 | 128.402 | 7.401 | 9.50 |
| G377H | 146.855 | 8.34 | 12.25 | 104.837 | 10.117 | 10.61 |
| G377K | 185.922 | 4.42 | 8.21 | 119.751 | 4.989 | 5.97 |
| G377R | 119.708 | 5.87 | 7.03 | 94.749 | 7.137 | 6.76 |
| G377S | 108.609 | 6.91 | 7.51 | 101.106 | 7.877 | 7.96 |
| G377T | 112.557 | 17.14 | 19.29 | 109.036 | 18.279 | 19.93 |
| F380W | 147.077 | 9.97 | 14.67 | 104.881 | 9.253 | 9.70 |
| T381S | 135.827 | 13.41 | 18.21 | 112.559 | 10.315 | 11.61 |
| R383I | 527.820 | 6.33 | 33.44 | 98.328 | 7.522 | 7.40 |
| R383S | 132.894 | 10.50 | 13.96 | 119.466 | 10.545 | 12.60 |
| K385A | 126.096 | 4.64 | 5.85 | 112.706 | 0.000 | 0.00 |
| K385Q | 137.629 | 9.03 | 12.43 | 124.892 | 7.512 | 9.38 |
| K385V | 112.581 | 5.12 | 5.76 | 80.571 | 2.979 | 2.40 |
| E389A | 306.767 | 2.13 | 6.53 | 224.872 | 1.824 | 4.10 |
| E389G | 113.253 | 2.13 | 2.41 | 139.901 | 0.000 | 0.00 |
| E389L | 143.219 | 14.24 | 20.40 | 112.185 | 12.609 | 14.15 |
| E389Q | 135.807 | 11.88 | 16.14 | 99.738 | 12.767 | 12.73 |
| E389S | 165.620 | 0.00 | 0.00 | 93.030 | 0.285 | 0.27 |
| E392A | 112.465 | 7.27 | 8.18 | 155.693 | 6.376 | 9.93 |
| E392F | 115.619 | 3.90 | 4.51 | 143.781 | 3.905 | 5.61 |
| E392Q | 112.993 | 10.53 | 11.89 | 93.789 | 16.705 | 15.67 |
| E392R | 129.528 | 3.69 | 4.79 | 123.407 | 2.947 | 3.64 |
| E392V | 124.365 | 7.73 | 9.61 | 154.768 | 6.404 | 9.91 |
| Q393F | 139.966 | 10.59 | 14.82 | 101.647 | 10.171 | 10.34 |
| Q393M | 139.696 | 1.60 | 2.24 | 86.966 | 3.086 | 2.68 |
| S395A | 208.246 | 12.98 | 27.04 | 112.714 | 12.395 | 13.97 |
| S395H | 159.975 | 12.55 | 20.07 | 113.401 | 10.452 | 11.85 |
| E396A | 131.894 | 8.42 | 11.10 | 128.716 | 9.777 | 12.58 |
| E396H | 210.364 | 9.19 | 19.33 | 128.557 | 3.216 | 4.14 |
| E396Q | 122.977 | 10.06 | 12.37 | 95.938 | 10.263 | 9.85 |
| E396S | 156.267 | 2.77 | 4.33 | 111.753 | 2.022 | 2.26 |
| Y399T | 130.536 | 0.00 | 0.00 | 122.738 | 0.050 | 0.06 |
| Y399V | 110.592 | 15.98 | 17.68 | 116.018 | 17.801 | 20.65 |
| Y399W | 122.500 | 13.76 | 16.86 | 103.346 | 11.973 | 12.37 |
| S401A | 122.003 | 13.90 | 16.96 | 99.275 | 13.024 | 12.93 |
| S401E | 125.223 | 16.30 | 20.42 | 128.670 | 15.000 | 19.30 |
| S404A | 149.379 | 0.00 | 0.00 | 105.443 | 1.102 | 1.16 |
| L406F | 122.805 | 0.00 | 0.00 | 146.122 | 0.000 | 0.00 |
| L406N | 152.836 | 6.36 | 9.72 | 131.321 | 6.705 | 8.81 |
| S407A | 141.351 | 11.33 | 16.02 | 110.376 | 16.836 | 18.58 |
| S407D | 241.053 | 11.29 | 27.22 | 98.135 | 10.120 | 9.93 |
| S407P | 143.308 | 6.85 | 9.81 | 121.898 | 11.088 | 13.52 |
| A412Q | 146.177 | 9.54 | 13.94 | 99.452 | 8.511 | 8.46 |
| A412R | 140.070 | 8.92 | 12.49 | 123.675 | 9.390 | 11.61 |
| A412V | 146.804 | 4.99 | 7.32 | 101.739 | 5.383 | 5.48 |
| D416L | 120.820 | 17.64 | 21.31 | 127.662 | 15.340 | 19.58 |
| D418R | 117.749 | 7.59 | 8.94 | 112.193 | 10.721 | 12.03 |
| A419H | 241.224 | 8.82 | 21.27 | 188.179 | 5.999 | 11.29 |
| A419K | 191.165 | 10.42 | 19.91 | 2022.616 | 1.523 | 30.81 |
| D421A | 102.111 | 12.49 | 12.75 | 301.584 | 4.510 | 13.60 |
| D421H | 333.471 | 10.18 | 33.95 | 67.652 | 86.552 | 58.55 |
| D421K | 124.190 | 7.62 | 9.46 | 102.316 | 13.562 | 13.88 |
| D421N | 110.806 | 14.96 | 16.58 | 100.116 | 16.449 | 16.47 |
| D421Q | 104.370 | 10.72 | 11.18 | 143.630 | 12.400 | 17.81 |
| D421R | 138.783 | 8.85 | 12.28 | 137.964 | 9.778 | 13.49 |
| D421S | 142.171 | 11.00 | 15.64 | 166.162 | 8.564 | 14.23 |
| A425G | 74.810 | 10.61 | 7.94 | 120.947 | 11.137 | 13.47 |
| G427Q | 133.135 | 2.31 | 3.08 | 98.243 | 8.618 | 8.47 |
| G427T | 125.113 | 4.81 | 6.02 | 119.058 | 3.956 | 4.71 |
| V428L | 137.044 | 1.81 | 2.48 | 109.390 | 0.990 | 1.08 |
| D431E | 70.178 | 26.32 | 18.47 | 95.135 | 20.739 | 19.73 |
| D431H | 186.490 | 7.32 | 13.65 | 95.071 | 9.941 | 9.45 |
| D431K | 240.835 | 11.61 | 27.97 | 68.277 | 20.207 | 13.80 |
| D431L | 129.149 | 10.49 | 13.54 | 119.177 | 11.740 | 13.99 |
| D431N | 138.404 | 9.79 | 13.55 | 125.433 | 9.246 | 11.60 |
| D431Q | 232.960 | 10.83 | 25.23 | 109.483 | 10.716 | 11.73 |
| D431S | 78.069 | 7.52 | 5.87 | 88.796 | 9.135 | 8.11 |

TABLE 12-continued

| | Percent (%) Activity | | | | | |
|---|---|---|---|---|---|---|
| | duplicate 1 | | | duplicate 2 | | |
| | % activity at 37° C./4° C. | % activity 37° C. + m-cresol/37° C. | % activity 37° C. + m-cresol/4° C. | % activity at 37° C./4° C. | % activity 37° C. + m-cresol/37° C. | % activity 37° C. + m-cresol/4° C. |
| F433A | 147.286 | 9.78 | 14.40 | 99.486 | 12.798 | 12.73 |
| F433H | 140.196 | 13.48 | 18.90 | 87.943 | 16.888 | 14.85 |
| F433I | 108.569 | 11.30 | 12.27 | 86.984 | 16.616 | 14.45 |
| F433K | 91.159 | 11.12 | 10.14 | 342.290 | 3.608 | 12.35 |
| F433R | 128.958 | 10.53 | 13.58 | 133.353 | 9.565 | 12.75 |
| F433T | 161.799 | 13.66 | 22.10 | 134.977 | 19.229 | 25.96 |
| F433V | 1412.071 | 1.61 | 22.69 | 112.033 | 17.307 | 19.39 |
| F433W | 149.049 | 10.46 | 15.59 | 113.585 | 7.530 | 8.55 |
| P437I | 148.880 | 2.39 | 3.56 | 107.028 | 1.782 | 1.91 |
| M438A | 106.463 | 10.07 | 10.72 | 135.705 | 10.194 | 13.83 |
| M438D | 105.370 | 10.16 | 10.71 | 113.283 | 2.590 | 2.93 |
| M438E | 115.061 | 8.00 | 9.21 | 113.782 | 9.120 | 10.38 |
| M438L | 65.794 | 10.06 | 6.62 | 214.958 | 6.526 | 14.03 |
| M438N | 130.428 | 8.06 | 10.52 | 100.669 | 11.889 | 11.97 |
| M438T | 104.058 | 13.39 | 13.93 | 103.691 | 12.160 | 12.61 |
| E439A | 137.279 | 11.63 | 15.97 | 95.555 | 14.073 | 13.45 |
| E439A | 154.140 | 4.72 | 7.28 | 147.295 | 7.415 | 10.92 |
| E439C | 193.243 | 14.69 | 28.38 | 111.719 | 15.734 | 17.58 |
| E439K | 124.464 | 13.28 | 16.52 | 104.762 | 10.552 | 11.05 |
| E439P | 118.340 | 15.59 | 18.44 | 87.446 | 14.998 | 13.12 |
| E439Q | 101.589 | 10.67 | 10.84 | 127.358 | 10.648 | 13.56 |
| E439T | 110.891 | 14.36 | 15.93 | 122.975 | 11.322 | 13.92 |
| T440D | 118.877 | 11.52 | 13.69 | 79.518 | 18.426 | 14.65 |
| T440H | 142.296 | 4.46 | 6.34 | 130.928 | 7.553 | 9.89 |
| T440M | 84.722 | 8.83 | 7.48 | 86.929 | 12.774 | 11.10 |
| T440P | 111.931 | 13.54 | 15.16 | 91.205 | 17.272 | 15.75 |
| T440S | 100.436 | 11.17 | 11.22 | 131.174 | 9.810 | 12.87 |
| E441F | 129.315 | 11.25 | 14.55 | 110.874 | 11.410 | 12.65 |
| E442G | 111.216 | 10.24 | 11.39 | 100.210 | 10.965 | 10.99 |
| P443E | 94.377 | 5.14 | 4.85 | 130.704 | 6.789 | 8.87 |
| P443F | 146.612 | 11.22 | 16.45 | 97.932 | 12.322 | 12.07 |
| P443G | 239.171 | 8.56 | 20.48 | 157.960 | 16.385 | 25.88 |
| Q444E | 81.997 | 8.54 | 7.01 | 160.917 | 9.561 | 15.38 |
| Q444H | 150.301 | 8.46 | 12.71 | 119.665 | 10.892 | 13.03 |
| Q444V | 129.822 | 13.49 | 17.51 | 122.591 | 10.995 | 13.48 |
| I445M | 85.090 | 17.25 | 14.68 | 101.149 | 15.393 | 15.57 |
| I445N | 106.430 | 13.89 | 14.79 | 87.351 | 12.945 | 11.31 |
| I445W | 117.213 | 11.70 | 13.72 | 100.037 | 10.983 | 10.99 |
| Y447E | 99.579 | 16.55 | 16.48 | 108.969 | 12.849 | 14.00 |
| Y447G | 143.704 | 13.77 | 19.79 | 103.624 | 11.563 | 11.98 |
| Y447P | 139.152 | 13.78 | 19.17 | 107.737 | 12.282 | 13.23 |
| positive control (OHO) | 94.998 | 5.23 | 4.97 | 96.871 | 8.456 | 8.19 |
| | 105.798 | 4.48 | 4.74 | 108.066 | 5.246 | 5.67 |
| | 100.000 | 3.33 | 3.33 | 82.7780 | 3.759 | 4.59 |
| | 94.762 | 19.07 | 18.07 | 109.539 | 16.529 | 18.11 |
| | 142.024 | 4.48 | 6.36 | 130.947 | 5.595 | 7.33 |
| | 45.115 | 20.77 | 9.37 | 68.017 | 11.035 | 7.51 |
| | 53.324 | 21.95 | 11.71 | 74.253 | 9.960 | 7.40 |
| | 59.581 | 25.24 | 15.04 | 75.872 | 16.231 | 12.31 |
| | 91.844 | 19.05 | 17.50 | 80.371 | 13.977 | 11.23 |
| | 93.828 | 13.47 | 12.63 | 96.630 | 19.454 | 18.80 |
| | 57.773 | 17.04 | 9.85 | 83.536 | 17.573 | 14.68 |
| | 100.000 | 18.56 | 18.56 | 148.226 | 16.239 | 24.07 |
| | 74.325 | 18.29 | 13.60 | 61.119 | 9.286 | 5.68 |
| | 98.132 | 8.48 | 8.32 | 87.677 | 10.006 | 8.77 |
| | 93.817 | 9.62 | 9.02 | 102.223 | 9.745 | 9.96 |
| | 96.922 | 8.56 | 8.30 | 87.993 | 9.064 | 7.98 |
| | 96.648 | 9.91 | 9.58 | 86.891 | 9.938 | 8.63 | n/a (not available; e.g., beyond detection limit)

2. Summary of Results for F204P

For mutant F204P, the results above of tested supernatant from transient transfection of CHO—S cells incubated in the presence of m-cresol in a bHA enzymatic activity assay showed that the F204P mutant protein was highly resistant to 0.4% m-cresol treatment. The results showed that the activity that remained after 4 hours incubation with 0.4% m-cresol at 37° C. was approximately equal to the activity observed when the enzyme was incubated at either 4° C. or at 37° C. in the absence of m-cresol. The positive control (WT PH20-OHO) showed a reduction in activity of 75% and 83% on the day of the assay (as assayed from two different OHO transfections). This demonstrated that the F204P phenophile was able to retain 60% to 90% or greater of its activity above the residual activity of the wildtype PH20 control enzyme.

In order to confirm the stability of F204P upon m-cresol treatment or exposure to increased temperature, a second transfection of F204P was performed in duplicate using CHO—S cells, and clarified supernatant was again tested for its stability at 4° C., at 37° C. for 4 hours with 0.4% m-cresol and at 37° C. for 4 hours without 0.4% m-cresol. The results confirmed that the F204P mutant enzyme retained a high amount of hyaluronidase activity after the 4 hour incubation in m-cresol at 37° C. The results were similar to the results seen in the first screening of the mutant, with F204P retaining anywhere from 57% to greater than 90% of its activity above the residual activity of the wildtype PH20 control enzyme after the 4 hour incubation.

A summary of the enzyme activity of F204P compared to the wildtype control is set forth in Table 13.

TABLE 13

Summary of Enzyme Activity

| Transfection # | Remaining Activity after 4 h incubation (37° C. + m-cre/ 37° C.) | | Net % Increase in Activity Over WT (37° C.) | Remaining Activity after 4 h incubation (37° C. + m-cre/ 4° C.) | | Net % Increase in Activity Over WT (4° C.) |
|---|---|---|---|---|---|---|
| | F204P | WT (OHO) | | F204P | WT (OHO) | |
| 1 | 73.6% | 16.4% | 57.2% | 86.0% | 25.3% | 60.7% |
| 2 | 122.3% | 25.2% | 97.1% | 109.7% | 16.6% | 93.1% |

Example 6

Large Scale Expression and Purification of PH20 Hit Variant

1. Expression and Purification

HZ24-PH20-IRES-SEAP plasmid DNA containing cDNA encoding one of the variant PH20 was transfected into monolayer CHO—S cells as generally described in Example 2. CHO—S cells were cultured in shaker flasks using CD-CHO media supplemented with GlutaMAX (8 mM). On the day of transfection, 15 flasks were prepared of approximately 300 mL volume containing the CHO—S cells at an approximate density of $1.0 \times 10^6$ cells/mL. Each 300 mL flask was transfected using 375 µg of plasmid DNA encoding the F204P mutant combined with 375 µL of Freestyle MAX transfection reagent. The transfected plasmid DNA had a sequence of nucleotides set forth in SEQ ID NO:4 containing a codon change of TTC to CCT at nucleotide positions 1733-1735, thereby encoding the F204P mutant. The transfected cells were then allowed to remain in culture for 96 hours, whereupon the cells and media were harvested and pooled. The cells were pelleted by centrifugation (4000× g, 20'), and the supernatant retained for purification of the F204P protein (approximately 4.5 liters).

The crude supernatant was concentrated 10× using a 30 kDa Tangential flow filter (TFF) system (Millipore Pellicon XL, Bimax 30, 200 mL void volume; 50 cm² filter surface area) until the volume was approximately 450 mL. The permeate was saved for assay to detect flow through of the F204P protein. A free-flow buffer exchange for the retentate was then performed using 4 liters of buffer (10 mM NaPO₄; 25 mM NaCl, pH 7.2). The volume of the retentate was reduced again to approximately 200 mL, and then the remaining permeate in the system was purged (void volume ~200 mL) and the system was flushed using approximately 50 mL of buffer to yield a final concentrated product of approximately 450 mL.

An anti-rHuPH20 affinity column was prepared by coupling antigen affinity purified Rabbit anti-rHuPH20 IgG to CNBr-activated Sepharose 4 Fast Flow (GEHealth catalog No. 17-0981-01). Briefly, 0.7 g of pre-activated Sepharose 4 powder was suspended in 1 mM HCl in a 10 mL glass column for 30 minutes to allow the powder to swell. The solution was drained from the column and washed with 15 gel volumes (about 30 mL) of cold 1 mM HCl by gravity. The column was washed with 5 gel volumes of coupling buffer (0.1M NaHCO₃, 0.5M NaCl at pH 8.3). Next, 5 mg of Rabbit anti-rHuPH20 IgG at >1.0 mg/mL in coupling buffer was added to the column at a protein/gel ratio of 2-3 mg/mL gel. The column was rotated head to head at 4° C. overnight. The flow-through was collected for coupling efficiency determination. The gel was washed with 2 gel volumes of coupling buffer, and then washed and resuspended in 1 M ethanolaminine pH 9.5 for 2 hours at room temperature to block unused activated sites. The gel was washed 6 times with 5 gel volumes per wash alternating coupling buffer and 0.1 NaAc, 0.5M NaCl, pH 4.5. The gel was then washed with 10 gel volumes of TBS (20 mM Tris-HCl, 0.15 M NaCl, pH 7.5). The coupling efficiency was determined (1-post-coupling protein concentration/pre-coupling protein concentration×100%). The antibody coupled gel was stored in TBS with 0.02% NaN₃ at 4° C.

The concentrated supernatant product was subsequently loaded onto a anti-rHuPH20 affinity column at an approximate rate of 5 mL/min. The elution was performed according to standard procedure using a GE™ AKTA FPLC purification system (GE Healthcare, Product No. 18-1900-26), whereby the protein was eluted via a low pH glycine wash (0.1 M glycine-HCl, pH 2.5) in 1 mL fractions. Each fraction was immediately neutralized by the addition of 100 µL of 1M Tris, pH 7.5.

The eluted protein was assayed by resolving protein bands on a 4-20% SDS-PAGE gradient Tris-glycine gel. See Blue®Plus2 Pre-stained MW standards (Life Technologies; Catalog No. LC5925) were used as molecular weight standards, and 50 ng rHuPH20 (as described in Example 1) was used as a positive control. The polyacrylamide gel was stained with Instant Blue to show total protein from each fraction. To confirm the bands on the gel are PH20, the gel was transferred to a PVDF membrane (Invitrogen), which was subjected to Western Blot using a Rabbit anti-PH20 primary antibody generated by immunizing rabbits with rHuPH20 and an HRP-Goat anti-rabbit secondary antibody (Calbiochem, Cat. No. DC03L).

Then, the flow-through from the initial loading of the affinity column was re-loaded onto the column twice due to the low capacity of the affinity column. All fractions containing the protein were then combined resulting in a total volume that was approximately 13 mL. This product was then dialyzed overnight versus four liters of buffer (10 mM NaPO$_4$, 140 mM NaCl, pH 7.2) using a Slide-A-Lyzer Dialysis Cassette G2 (20,000 MWCO) with a 15 mL capacity. The buffer was then changed and the product dialyzed against a second fresh four liters of the same buffer. The F204P protein was then concentrated using an Amicon Ultra Centrifugation column (Millipore; 10,000 MWCO) to a final volume of approximately 450 μL (10 minutes at 4000×g).

2. Characterization of Protein

The purified protein was characterized for its protein concentration, activity, and purity.

To determine the protein concentration of the purified protein, a quantification ELISA was performed as described in Example 7. Also, hyaluronidase activity was determined as described in Example 3. The protein concentration after centrifugation was estimated to be approximately 400 μg/mL. The purified protein also was resolved on a 4-20% SDS-PAGE gradient Tris-glycine gel, which was then stained with Instant Blue. The staining results demonstrated that the protein was essentially a single molecular weight protein of approximately 63 kDa, similar to the rHuPH20 control. No appreciable degradative products were detected by this method. Approximate yields of the protein at various timepoints and activity during the purification are described in Table 14.

TABLE 14

Characterization of Purification Steps

| Purification Step | Volume (mL) | Activity Assay | | Quant ELISA Assay | | Specific Activity (U/μg) |
|---|---|---|---|---|---|---|
| | | Activity (U/mL) | Total Activity (U) | Protein Conc. (μg/mL) | Total Protein (μg) | |
| Supernatant | 4500 | 2.66 | 11,700 | 0.046 | 207 | 56.5 |
| Conc. after TFF & Buffer Exchange | 450 | 42 | 18,900 | 0.4 | 178 | 105.9 |
| Pooled Fractions 5-7 after AC, Dialysis & Conc. - A280 | 0.45 | 11,741 | 5283 | 396 | 180 | 35.3 |

The purity of the purified protein was determined by Reverse Phase HPLC (RP-HPLC). The elution time from the reverse phase column was essentially identical as that observed with the recombinant human hyaluronidase (HUB), and provides a basis for crude estimation of the purity of the sample at approximately 80-90%.

Example 7

Quantification Using ELISA

The quantification of PH20 or variants were performed using an ELISA that captures the protein using a monoclonal anti-rHuPH20 capture antibody. Specifically, one day prior to performing the ELISA, 96-well 4HBX plates were coated with capture antibody (Protein G purified rabbit polyclonal anti-PH20 antibody generated by immunizing rabbits with rHuPH20; 1 mg/mL stock) at 1 μg/mL in 100 mM phosphate (pH 7.2) in a total volume of 100 μL per well. The plates were stored at 4° C. overnight. On the next day, the plates were washed 5× with 1×PBS at 300 μL/well with a plate washer. After each wash, the plated were patted dry on paper towels. Then, the plates were blocked with 200 μL PBS containing Tween 20 (1×PBST) per well at room temperature for 1 hour.

The standards and samples were added to the plate. For generation of the standard, a 1 mg/mL stock of rHuPH20 (Example 1) was freshly diluted to 50 μg/mL in HEPES pH 7.4 assay buffer as an intermediate stock. Then, for the standards, the 50 μg/mL stock was diluted in duplicates into 360 μL of 0.5×PBST at 300 ng/mL for the first standard (first row). For the other standard rows, 240 μL 0.5×PBST were added to each well, and 1:3 serial dilutions made. For the transfected supernatant samples, 360 μL per well was added in duplicate into the first row, and each were also serially diluted as described above into 0.5×PBST. For purified samples, 100 μL was added per well. The plates were incubated for 2 hours at room temperature. After incubation, the plates were washed 5× with 1×PBST at 300 μL/well using a plate washer. After each wash, the plates were patted dry on paper towels.

An HRP-conjugated anti-PH20 antibody was prepared for detection using an HRP conjugation kit (Pierce, Thermo-Fisher; Catalog No. 31489). 1 mg of a Protein G purified rabbit polyclonal antibody generated by immunizing rabbits with rHuPH20 was diluted in 1 mL PBS and 1 mL of 2× carbonate kit buffer. Next, 100 μL of peroxidase were added to 1 mL of the above antibody solution and incubated at room temperature for 1 hour. Then, 10 μL NaBH$_4$ stock was added in a fume hood, and the sample incubated at room temperature for 20 minutes. To quench the reaction, 20 μL of ethanolamine was added and incubated at room temperature for 15 minutes. To this, 1/25 volume 5% human serum albumin (0.1 mL syringe) was added to give a 2 mg/mL albumin stock reaction. The pH was adjusted to about 7.9 by addition of 250 μL of 1 M Tris pH 7.4. The concentration of the stock was 400 μg/mL. The stock solution was further diluted 1/10 in PBS Tween20 (0.05%) containing 0.5% human serum albumin and preservatives, and then was sterile filtered. The stock was stored at 4° C. or was frozen at −20° C.

Antibodies were detecting using the HRP-conjugated anti-PH20 antibody that was diluted 1000× into 0.5×PBST. 100 μL of the diluted antibody was added to all wells of the plate and the plate incubated for a further 2 hours at room temperature. After incubation, the plates were washed 5× with 1×PBST at 300 μL/well using a plate washer. After each wash, the plates were patted dry on paper towels. Then, 100 μL of TMB substrate were added to each well and the reaction was stopped after 5-10 minutes by adding 100 μL of stop solution per well. The plate was read at OD$_{450}$.

Example 8

Determination of Enzymatic Activity of PH20

Enzymatic activity of PH20 in samples such as cell cultures, purification fractions and purified solutions was determined using a turbidimetric assay, which is based on the formation of an insoluble precipitate when hyaluronic acid binds with cetylpyridinium chloride (CPC). The activity is measured by incubating PH20 with hyaluronan for a set period of time (30 minutes) and then precipitating the undigested hyaluronan with the addition of CDC. The turbidity of the resulting sample is measured at 640 nm. The decrease in turbidity resulting from enzyme activity on the hyaluronan substrate is a measure of the PH20 enzymatic activity. The method is run using a calibration curve generated with dilutions of a PH20 assay working reference standard (rHuPH20 standard generated as described in Example 1), and sample activity measurements are made relative to this calibration curve.

Dilutions of the sample and standards were prepared in Enzyme Diluent Solution (70 mM NaCl, 0.1% human serum albumin [HSA], 0.67 g/L gelatin hydrolysate in 25 mM PIPES buffer, pH 5.5). The samples were diluted to an appropriate concentration. Hyaluronic acid (HA, average MW of 20-50 kDa) from Lifecore Biomedical (Chaska, Minn.) also was prepared at 1 mg/mL in substrate solution that contains 25 mM PIPES, 70 mM NaCl at pH 5.5. Equal amounts of the above two solutions were mixed to prepare a 1 mL reaction mixture and incubated at 37° C. for 30 min. The reaction was stopped by addition of 4 mL of Cetylpyridinium Chloride Solution (CPC, 5.0 mg/mL). After brief vortexing, the turbidity of the sample mixture was read at 640 nm and the activity was determined by fitting against a standard curve. Specific activity (Units/mg) was calculated by dividing the enzyme activity (U/mL) by the protein concentration (mg/mL).

Example 9

Stability of F204P-PH20 Variant in Preservative

To confirm the screening results, an amount estimated to be about 450 U/mL of the purified F204P protein as described in Example 6 was formulated in 10 mM sodium phosphate, pH 6.5, 120 mM NaCl, 10 mM methionine, 0.01% Pluronic F-68, 0.1% phenol and 0.15% m-cresol. A test article that also contained an amount estimated to be about 450 U/mL wild type rHuPH20 (generated as described in Example 1) in the same formulation was also prepared to serve as a control. Each formulation solution was aliquotted in 0.5 mL and filled into 2 mL USP Type I borosilicate glass with a chlorobutyl rubber stopper and an aluminum seal. The vials were incubated at 5° C., 30° C. or 37° C. Samples were withdrawn from the incubator at various times and enzymatic activity was measured as described in Example 8.

The results of the enzymatic activity measurements are shown in Table 15. As can be seen, the rHuPH20 wild type control showed a rapid decrease in activity when incubated at 37° C. in the presence of phenolic preservatives. In contrast, the F204P mutant showed no significant loss in activity throughout the study. The results also show that activity of PH20 is retained after incubation for up to 4 weeks at 5° C. and 30° C. compared to the activity of the rHuPH20 wildtype control not containing the mutation. These results confirm that F204P tolerates EPB level of preservative (0.1% phenol and 0.15% m-cresol) and is stable at 37° C. for at least up to 6 days at at 5° C. and 30° C. for greater than one month.

Example 10

Stability of F204P-PH20 Variant in Insulin Coformulation

The PH20 variant F204P was tested for its stability in a coformulation containing an insulin analog (insulin aspart or insulin lispro).

In the tested coformulations, the insulin lispro was a commercial product (Insulin Lispro: Eli Lilly Humalog® (insulin Lispro) 100 U/mL, Lot A572364).

In the tested coformulations, the insulin aspart analog was a reprocessed aspart prepared by pooling 12 vials (10 mL each) of a commercial product (Insulin Aspart: Novo Nordisk, NovoRapid® (insulin Aspart), Lot XS60195), which was then concentrated using an Amicon Ultracel-10 K column concentrator until the final concentration was about 5 times the original concentration. The insulin analog was precipitated by addition of 1 M sodium acetate, pH 5.3 and 30 mM zinc chloride ($ZnCl_2$, EMD, Cat No. ZX0065-1) at $\frac{1}{10}$ of the protein solution volume. The solution was placed on ice for 30 minutes followed by centrifugation at 5600 rpm for 20 minutes in an Avanti J-E Centrifuge with JS-5.3 swinging bucket rotor (Beckman Coulter). The supernatant was decanted and the pellet was resuspended and washed with 20 mM sodium acetate, 2 mM zinc chloride, pH 5.5 solution. The resuspended solution was centrifuged as described above. The washing step was repeated a total of 5 times. A final wash was performed with 20 mM sodium acetate, pH 5.5 to remove all traces of zinc chloride. The resulting protein paste was dissolved with water containing 20 mM HCl. After complete dissolution, 250 mM Tris, pH 10.7 was added to a final Tris concentration of 20 mM. The pH of the resulting solution was adjusted such that the insulin analog was formulated as described below and the protein concentration was adjusted to about 15-20 mg/mL. An insulin analog prepared in this way typically had a yield of about 90%, with a residual preservative concentration at less than 100 times the starting material.

Briefly, three (3) formulations were generated each containing 600 Units (U) of PH20-F204P or wildtype rHuPH20 (generated as described in Example 1) for a total of 6 formulations as set forth in Table 16:

TABLE 15

Stability of rHuPH20 wildtype and F204P mutant incubated at with preservative

| ID | PH20 relative activity (%) at 5° C. | | | | PH20 relative activity (%) at 30° C. | | | PH20 relative activity (%) at 37° C. | | |
|---|---|---|---|---|---|---|---|---|---|---|
| | T0 | 2 w | 4 w | 6 d | 2 w | 4 w | 2 d | 4 d | 6 d |
| F204P | 100 | — | 91.8 | 84.1 | 100 | 96.6 | 105 | 91.1 | 95.9 |
| wildtype control | 100 | — | 81.9 | 66.7 | 61.7 | 60.5 | 48.6 | 29.6 | 15.2 |

TABLE 16

Summary of Insulin Formulations

| | | Buffer | | Tonicity | | | | Preservatives | | | API | |
|---|---|---|---|---|---|---|---|---|---|---|---|---|
| ID | pH | NaPO$_4$ | Tris/HCl | modifier NaCl | Anti-Ox Methionine | Glycerin | Metal Zn | Surfactant F68 | Phenol | m-Cresol | PH20 (U/mL) | Analog (mg/mL) |
| F1. Humalog + F204P | 7.0-7.8 | 13.2 mM | | | | 173.7 mM | 0.242 mM | | | 0.315% | 600 | 3.5 |
| F2. Humalog + wt | 7.0-7.8 | 13.2 mM | | | | 173.7 mM | 0.242 mM | | | 0.315% | 600 | 3.5 |
| F3. Aspart + F204P | 7.3 | | 30 mM | 100 mM | 5 mM | | | 0.010% | 0.100% | 0.150% | 600 | 3.5 |
| F4. Aspart + wt | 7.3 | | 30 mM | 100 mM | 5 mM | | | 0.010% | 0.100% | 0.150% | 600 | 3.5 |
| F5. Aspart + F204P | 7.3 | | 30 mM | 100 mM | 5 mM | | | 0.010% | | 0.315% | 600 | 3.5 |
| F6. Aspart + wt | 7.3 | | 30 mM | 100 mM | 5 mM | | | 0.010% | | 0.315% | 600 | 3.5 |

Each formulation solution was dispensed in 0.5 mL aliquots into 2 mL USP Type I borosilicate glass vials with a chlorobutyl rubber stopper and an aluminum seal. The vials were incubated at 5° C., 30° C. and 37° C. Samples were withdrawn from the incubator at scheduled time points for enzymatic activity measurements as described in Example 8.

The results of the enzymatic activity measurements for samples incubated at 37° C., 30° C. and 5° C. are shown in Tables 17-19, respectively. At 37° C., the enzymatic activity of samples containing wildtype rHuPH20 (F2, F4 and F6) were almost totally lost within two days of incubation. In contrast, after 6 days incubation at 37° C., formulation F3 and F5, which contains PH20-F204P, lost only about 10% and 30%, respectively. The PH20-F204P formulated in commercial Humalog (F1) lost most of its activity within 2 days at 37° C. most likely due to the lack of NaCl in the formulation.

A similar trend for enzymatic activities of ampoules incubated at 30° C. was noted between the PH20-F204P and rHuPH20. For formulations that contain an EPA preservative level, the differences between wild type and F204P were dramatic (Table 17; F1 and F5 vs. F2 and F6). When the preservative concentration was reduced to an EPB level (F3 and F4), the F204P still outperformed wildtype rHuPH20, although there was slightly higher rHuPH20 stability compared to EPA conditions. In both EPA and EPB preservative levels, PH20-F204P was able to maintain its activity up to 14 days at 30° C. when 100 mM of NaCl was included in the formulation.

TABLE 17

Enzymatic activity of rHuPH20 wild type and F204P mutant incubated at 37° C.

| | PH20 activity U/mL, (% of remaining activity) | | | | |
|---|---|---|---|---|---|
| ID | Initial Activity | 2 d | 4 d | 6 d | 2 w |
| F1. Humalog + F204P | 583 (100%) | 61 (10%) | 15 (3%) | 10 (2%) | — |
| F2. Humalog + wt | 439 (100%) | 4 (1%) | — | — | — |
| F3. Aspart + F204P | 625 (100%) | 613 (98%) | 496 (79%) | 570 (91%) | 532 (85%) |
| F4. Aspart + wt | 566 (100%) | 58 (10%) | 24 (4%) | 4 (1%) | — |
| F5. Aspart + F204P | 657 (100%) | 484 (74%) | 462 (70%) | 478 (73%) | 360 (55%) |
| F6. Aspart + wt | 596 (100%) | −1 (0%) | — | — | — |

TABLE 18

Enzymatic activity of rHuPH20 wild type and F204P mutant incubated at 30° C.

| | PH20 activity U/mL, (% of remaining activity) | | | |
|---|---|---|---|---|
| ID | Initial Activity | 6 d | 2 w | 4 w |
| F1. Humalog + F204P | 583 (100%) | 345 (59%) | 250 (43%) | 111 (19%) |
| F2. Humalog + wt | 439 (100%) | 1 (0%) | 16 (4%) | −1 |
| F3. Aspart + F204P | 625 (100%) | 601 (96%) | 650 (104%) | 579 (93%) |
| F4. Aspart + wt | 566 (100%) | 428 (76%) | 390 (69%) | 277 (49%) |
| F5. Aspart + F204P | 657 (100%) | 632 (96%) | 655 (100%) | 561 (85%) |
| F6. Aspart + wt | 596 (100%) | 145 (24%) | 65 (11%) | 9 (1.5%) |

TABLE 19

Enzymatic Activity at 5° C.

| | PH20 activity (U/mL) at 5° C. | | |
|---|---|---|---|
| ID | Initial Activity | 2 w | 4 w |
| F1. Humalog + F204P | 583 | 544 | 565 |
| F2. Humalog + wt | 439 | 428 | 404 |
| F3. Aspart + F204P | 625 | 647 | 607 |
| F4. Aspart + wt | 566 | 580 | 496 |
| F5. Aspart + F204P | 657 | 695 | 574 |
| F6. Aspart + wt | 596 | 583 | 519 |

Example 11

Stability of V58R-PH20 in Insulin Coformulation

A. Stability of V58R-PH20

The PH20 variant V58R was expressed in CHO—S cells as described in Example 2 or Example 6. The transfected plasmid DNA had a sequence of nucleotides set forth in SEQ ID NO:4 containing a codon change of GTG to CGG at nucleotide positions 1295-1297, thereby encoding the V58R mutant. The V58R mutant was tested for its stability in a coformulation containing insulin aspart (insulin aspart analog prepared as described in Example 10) and under EPA or EPB preservative levels. Briefly, four (4) formulations were generated each containing 600 Units (U) of PH20-V58R or wildtype rHuPH20 (generated as described in Example 1) as set forth in Table 20. Formulations F1 and F2 represent the EPB preservative levels while formulations F3 and F4 represent the EPA preservative levels.

TABLE 20

Summary of Insulin Formulations

| | | Buffer | | Tonicity modifier | Anti-Ox | | Metal | Surfactant | Preservatives | | API | |
|---|---|---|---|---|---|---|---|---|---|---|---|---|
| ID | pH | NaPO₄ | Tris/HCl | NaCl | Methionine | Glycerin | Zn | F68 | Phenol | m-Cresol | PH20 (U/mL) | Analog (mg/mL) |
| F1. Aspart + V58R | 7.3 | 30 mM | | 100 mM | 5 mM | | | 0.010% | 0.100% | 0.150% | 600 | 3.5 |
| F2. Aspart + rHuPH20 wt | 7.3 | 30 mM | | 100 mM | 5 mM | | | 0.010% | 0.100% | 0.150% | 600 | 3.5 |
| F3. Aspart + V58R | 7.3 | 30 mM | | 100 mM | 5 mM | | | 0.010% | | 0.315% | 600 | 3.5 |
| F4. Aspart + rHuPH20 wt | 7.3 | 30 mM | | 100 mM | 5 mM | | | 0.010% | | 0.315% | 600 | 3.5 |

Each formulation solution was dispensed in 0.5 mL aliquots into 2 mL USP Type I borosilicate glass vials with a chlorobutyl rubber stopper and an aluminum seal. The vials were incubated at 30° C. and 37° C. Samples were withdrawn from the incubator at scheduled time points for enzymatic activity measurements as described in Example 8.

The results of the enzymatic activity measurements for samples incubated at 37° C. and 30° C. are shown in Table 21 and Table 22. At 37° C., the enzymatic activity of samples containing wildtype rHuPH20 (F2 and F4) were almost totally lost within two days of incubation. In contrast, after 6 days incubation at 37° C., formulations F1 (EPB) and F3 (EPA), containing V58R-PH20, lost only about 25% and 40% activity, respectively. At 30° C., the enzymatic activity of samples containing wildtype rHuPH20 also was dramatically reduced in the presence of EPA or EPB preservatives levels within one month of incubation, although there was a slightly less dramatic loss in activity in the presence of EPB preservative levels. In contrast, for V58R-PH20, there was no loss of enzymatic activity for either tested formulation up to 1 month.

TABLE 21

Enzymatic activity of rHuPH20 wild type and V58R mutant incubated at 37° C.

| | PH20 activity U/mL | | | |
|---|---|---|---|---|
| Formulation | Initial Activity | 2 d | 4 d | 6 d |
| F1. Aspart + V58R | 1350 | 1099 | 1094 | 1006 |
| F2. Aspart + rHuPH20 wt | 677 | 53 | −3 | — |
| F3. Aspart + V58R | 1189 | 793 | 581 | 464 |
| F4. Aspart + rHuPH20 wt | 744 | 12 | −9 | — |

TABLE 22

Enzymatic activity of rHuPH20 wild type and V58R mutant incubated at 30° C.

| | PH20 activity U/mL | | |
|---|---|---|---|
| Formulation | Initial Activity | 2 weeks | 4 weeks |
| F1. Aspart + V58R | 1350 | 1368 | 1208 |
| F2. Aspart + rHuPH20 wt | 677 | 422 | 256 |
| F3. Aspart + V58R | 1189 | 1228 | 1171 |
| F4. Aspart + rHuPH20 wt | 744 | 21 | −5 |

B. Comparison of Stability of F204P and V58R

The PH20 variant V58R-PH20 was compared to F204P for its stability in a coformulation containing insulin aspart (insulin aspart analog prepared as described in Example 10) and under EPA or EPB preservative levels. Briefly, eight (8) formulations were generated as set forth in Table 23. Formulations F1-F4 represent the EPB preservative levels while formulations F5-F8 represent the EPA preservative levels. Formulations F3 and F4 and formulations F7 and F8 were identical and represent the wildtype control formulations formulations used for the EPB or EPA studies, respectively.

TABLE 23

Summary of Insulin Formulations

| ID | pH | Buffer NaPO₄ | Tris/HCl | Tonicity modifier NaCl | Anti-Ox Methionine | Glycerin | Metal Zn | Surfactant F68 | Phenol | Preservatives m-Cresol | API PH20 U/mL | Analog mg/mL |
|---|---|---|---|---|---|---|---|---|---|---|---|---|
| F1. Aspart + V58R | 7.3 | | 30 mM | 100 mM | 5 mM | | | 0.010% | 0.100% | 0.150% | 600 | 3.5 |
| F2. Aspart + F204P | 7.3 | | 30 mM | 100 mM | 5 mM | | | 0.010% | 0.100% | 0.150% | 600 | 3.5 |
| F3. Aspart + rHuPH20 wt(1) | 7.3 | | 30 mM | 100 mM | 5 mM | | | 0.010% | 0.100% | 0.150% | 600 | 3.5 |
| F4. Aspart + rHuPH20 wt(2) | 7.3 | | 30 mM | 100 mM | 5 mM | | | 0.010% | 0.100% | 0.150% | 600 | 3.5 |
| F5. Aspart + V58R | 7.3 | | 30 mM | 100 mM | 5 mM | | | 0.010% | | 0.315% | 600 | 3.5 |
| F6. Aspart + F204P | 7.3 | | 30 mM | 100 mM | 5 mM | | | 0.010% | | 0.315% | 600 | 3.5 |
| F7. Aspart + rHuPH20 wt(1) | 7.3 | | 30 mM | 100 mM | 5 mM | | | 0.010% | | 0.315% | 600 | 3.5 |
| F8. Aspart + rHuPH20 wt(2) | 7.3 | | 30 mM | 100 mM | 5 mM | | | 0.010% | | 0.315% | 600 | 3.5 |

Each formulation solution was dispensed in 0.5 mL aliquots into 2 mL USP Type I borosilicate glass vials with a chlorobutyl rubber stopper and an aluminum seal. The vials were incubated at 30° C. and 37° C. Samples were withdrawn from the incubator at scheduled time points for enzymatic activity measures as described in Example 8.

The results show that the percentage hyaluronidase activity in the tested formulations after preincubation at 37° C. was slightly greater for both PH20 mutants when formulated in EPB and not EPA preservative levels. While the percent of activity remaining was greater than 80% for both tested mutants after 6 days incubation in formulations containing EPB preservative levels, it was less in the presence of EPA preservative levels. For example, the activity remaining at 6 days in EPA preservative levels was slightly less than 80% after 6 days for F204P-PH20, while it was only about 40% for V58R-PH20. Hence, the results also show that at 37° C., V58R-PH20 is somewhat less stable than the F204P-PH20, in particular in a formulation with EPA preservative levels. After incubation at 30° C. for at least a week, the F204P-PH20 and V58R-PH20 were stable and exhibited almost 100% initial activity in the presence of both EPA and EPB preservative levels. In contrast, rHuPH20 exhibited only about 40% of its initial activity after 4 weeks at 30° C. in the presence of EPB preservative levels, while it exhibited no detectable activity after 4 weeks at 30° C. in the presence of EPA preservative levels.

Example 12

Expression of F204P-PH20 Using a Lentivirus Expression Vector

A lentivirus expression vector, pLV-EF1a-PH20(F204P)-IRES-GFP-Bsd was generated containing a codon-optimized mutant hyaluronidase cDNA encoding F204P-PH20. The sequence of pLV-EF1a-PH20(F204P)-IRES-GFP-Bsd is set forth in SEQ ID NO:925. The pLV-EF1a-PH20 (F204P)—IRES-GFP-Bsd vector contains an ampicillin resistance gene (AmpR) located at nucleotides 8611-9471, an EF1a promoter at residues 1933 to 2327, an IRES at residues 4786-5370, a GFP-Bsd at residues 5394-6527 and nucleotides encoding F204P-PH20 at residues 3369-4781.

Lentivirus was produced as described in Bandaranayake et al. ((2011) Nucleic Acids Research, 39:e143). Briefly, 293T cells (ATCC) were plated at 6×10⁶ cells onto 10 cm tissue culture plates. After 24 hours, 6 μg of psPAX2 (SEQ ID NO:926; Addgene plasmid No. 12260), 3 μg of PMD2.G (SEQ ID NO:927; Addgene plasmid #12259) and 9 μg lentiviral vector plasmid pLV-EF1a-PH20(F204P)-IRES-GFP-Bsd were mixed in 1.5 mL Opti-MEM (Life Technologies). 45 μL of Lipofectamine 2000 (LF2000; Life Technologies) were diluted into 1.5 mL Opti-MEM (Life Technologies). The DNA and LF2000 were mixed gently, and incubated at room temperature for 20 minutes to allow the DNA and lipid to form complexes. In the meantime, the overnight culture medium was replaced with 5.0 mL DMEM+10% FBS without antibiotics. A volume of 3.0 mL containing the DNA-LF2000 complexes were added to the 293T cells. The medium containing the DNA-LF2000 complexes was replaced with 10 mL complete medium at 12-16 hours post-transfection. The supernatant was collected at 48 hours post-transfection and the medium was transferred to a polypropylene storage tube. The virus-containing medium was spun at 1300 rpm for 5 minutes to pellet any 293T cells that were carried over during collection. The supernatant was carefully transferred to a sterile polypropylene storage tube.

CHO—S cells (Invitrogen) were grown in CHO—S media (Invitrogen) with shaking at 120 rpm at 37° C. and 5% CO₂ in vented 125-mL shake flasks (Nalgene). For transduction, CHO—S cells were added to wells of a six-well plate at 2*10⁶ cells per well in 2 ml of CHO—S media containing 4 μg/mL hexadimethrine bromide at a final concentration of 4 μg/mL (Polybrene; SIGMA). Virus was added to each well at a multiplicity of infection (MOI) of 10 and the cells were incubated with shaking (120 rpm) at 37° C. and 5% CO₂ for 6 hours. The cells were then harvested and pelleted by low speed centrifugation (500×g, 5 min). The transduction medium was removed and replaced with 10 mL of fresh CHO—S medium (Invitrogen) supplemented with GlutaMax (50 mL/liter) and transferred to a T-25 flask. Three days post infection, blasticidin (Invitrogen) was added to the growth medium at a concentration of 1 μg/mL. The medium was changed regularly at 3-4 day intervals, and the cells were transferred to a T75 flask for expansion. Two weeks after the initial infection, the cells were expanded to shaker flasks and maintained in culture using medium containing 1 μg/mL blasticidin. F204P-PH20 protein secreted into the CHO—S medium was collected and purified by affinity chromatography using an anti-rHuPH20 affinity column as described in Example 6. The protein was prepared in standard API buffer (10 mM Histidine, 130 mM NaCl, pH 6.5).

Example 13

Analysis of Secondary Structure and Melting Temperature

The secondary structure and melting temperature of the PH20 variant F204P was tested and compared to wild-type rHuPH20 (generated as described in Example 1) to further assess stability of the variant. The secondary structure was tested by circular dichroism. A Jasco J-810-150S equipped with PTC-424S was employed for the CD spectral measurement and the CD spectra were collected by Spectra Manager (Version 1.5, Jasco). Procedures for instrumental set up and data collection are described in Table 24.

TABLE 24

CD Spectroscopy Operation Conditions

| Parameters | Conditions |
| --- | --- |
| Nitrogen flow rate | 25 ft$^3$/h |
| Sample temperature | 30-75° C. |
| Sample concentration | Approx. 0.1 mg/mL |
| Cell pathlength | 1 mm |
| Wavelength | 220 nm |
| Data pitch | 1° C. |
| Delay time | 60 seconds |
| Temperature slope | 1° C./min |
| Sensitivity | standard |
| Response | 4 seconds |
| Band width | 1 nm |

1. Sample Preparation and Measurement

Two hundred (200) μL of a 0.1 mg·mL protein sample diluted in McIlvaine's buffer (McIlvaine (1921) JBC 49:183) adjusted to pH 6.5 were prepared. A series of samples of the F204P variant were also generated that varied in pH by adjustment using McIlvaine's buffer to a pH range from 5.0 to 7.5 as set forth in Table 25. In addition, samples also were generated by adjusting the NaCl concentration to 17.5 mM to 140 mM as set forth in Table 26. Samples were filtered using a 0.2 μm syringe filter prior to measurement. Similar samples were generated for rHuPH20. Then, 200 μL samples were transferred to a rectangular cuvetted having a 1 mm width and seated on Jasco J-810 spectropolarimeter. CD spectra of the samples were collected under the conditions described in Table 20. The melting temperature ($T_m$) was calculated using Spectra Manager (v 1.5, Jasco) from the CD spectral intensity measured at the temperature range from 30° C. to 75° C. The cuvettes were cleaned by Chromerge® cleaner (C577-12, Fisher scientific) between individual sample loading and after the run.

TABLE 25

Sample pH and concentration

| Target pH | Actual pH | F204P (μL) | Buffer (μL) | F204P concentration (mg/mL) |
| --- | --- | --- | --- | --- |
| 5.0 | 4.92 | 25 | 175 | 0.1 |
| 5.5 | 5.38 | 25 | 175 | 0.1 |
| 6.0 | 5.99 | 25 | 175 | 0.1 |
| 6.5 | 6.49 | 25 | 175 | 0.1 |
| 7.0 | 7.00 | 25 | 175 | 0.1 |
| 7.5 | 7.5 | 25 | 175 | 0.1 |

TABLE 26

Sodium Concentration in Samples at pH 6.5

| Target NaCl concentration (mM) | NaCl, 2.8M (μL) | F204P (μL) | Buffer at pH 6.5 (μL) | F204P concentration (mg/mL) |
| --- | --- | --- | --- | --- |
| 17.5 | 0.00 | 25 | 175 | 0.1 |
| 50.0 | 2.32 | 25 | 172.7 | 0.1 |
| 75.0 | 4.11 | 25 | 170.9 | 0.1 |
| 100.0 | 5.89 | 25 | 169.1 | 0.1 |
| 140.0 | 8.75 | 25 | 166.3 | 0.1 |

2. Results

The results show that the secondary structure of F204P is similar to rHuPH20. As a function of temperature, circular dichroism showed that a change in the absorption was measured with increasing temperatures. As a function of pH, the $T_m$ distribution was closely comparable for both F204P and rHuPH20 and the highest $T_m$ for each was obtained between pH 5.5 and pH 6.0. The results, however, showed that $T_m$ of the F204P variant was approximately 9° C. higher at all tested ranges than wildtype rHuPH20. This result indicated that the F204P mutant is more stable against thermal stress conditions. As a function of salt, the results show that the F204P and wildtype rHuPH20 both exhibited an increasing $T_m$ with higher salt concentration, showing that both have a proportional inclination toward salt concentration.

Example 14

Assessment of Enzymatic Activity in an Intradermal Trypan Blue Dispersion Assay

Spreading activity of the PH20 variant F204P was assessed using a dye dispersion in vivo assay. Briefly, purified PH20 variant F204P (prepared as described in Example 12) and wild-type rHuPH20 (prepared as described in Example 1) were both formulated in API buffer (10 mM Histidine, 130 mM NaCl, pH 6.5) at a concentration of 10,000 U/mL. The stocks were further diluted to three target concentrations of 1000, 100 and 10 U/mL by serial 1:10 dilutions in API buffer. Purified proteins (either rHuPH20 or F204P-PH20) were diluted 1:1 with 0.4% Trypan Blue (0.4% liquid solution; Catalog No. 15250, Invitrogen) to give a final concentration of 5, 50 and 500 U/mL protein, each containing 0.2% trypan blue. A vehicle control (API buffer) also was prepared. Forty-two (42) female NCr nu/nu homozygous mice were used in the study with six mice used per group as set forth in Table 27.

TABLE 27

Summary of Treatment Groups for Dye Dispersion Study

| Group | No. of Mice | Test Article | Final Dose with Trypan Blue (Units/mL) | Trypan Blue | Injection Volume (mL) |
|---|---|---|---|---|---|
| 1 | 6 | Control | 0 | 0.2% | 0.04 |
| 2 | 6 | rHuPH20 | 5 | 0.2% | 0.04 |
| 3 | 6 | rHuPH20 | 50 | 0.2% | 0.04 |
| 4 | 6 | rHuPH20 | 500 | 0.2% | 0.04 |
| 5 | 6 | F204P-PH20 | 5 | 0.2% | 0.04 |
| 6 | 6 | F204P-PH20 | 50 | 0.2% | 0.04 |
| 7 | 6 | F204P-PH20 | 500 | 0.2% | 0.04 |

Forty (40) μL of samples were administered by a single intradermal injection. The area of dye dispersion was measured at 2.5, 5, 10, 15 and 20 minutes post-injection and was recorded by photographic imaging by photograph of the injection site with a Nikon D90 digital camera with 60 mm prime micro-lens. A laser distance meter (Leica D3) was used to accurately position the camera at a pre-determined distance from the Trypan Blue dye area on the animal. The area of the dye was determined using Image-Pro Analyzer 7.0 (MediaCybernetics, Inc). The calculated areas were expressed as $mm^2$.

The results are set forth in Table 28. The results showed that the dispersion activity of the PH20 variant F204P was substantially identical to the dispersion activity of rHuPH20. The ability to increase the area of dye dispersion was dose-dependent, with both proteins having greatest activity at 500 U/mL. The results also showed that the area of dye dispersion increased with time post-intradermal injection. The areas of dye dispersion of rHuPH20 and F204P-PH20 were significantly greater than the areas of dye dispersion for the controls ($p<0.05$) at all time points when formulated at all concentrations (5, 50 and 500 U/mL) with the exception of rHuPH20 at the lowest concentration (5 U/mL). When compared to each other, rHuPH20 and F204P-PH20 showed similar dispersion effects, although there was a significant difference in dispersion between the two groups at 5 U/mL and 500 U/mL but not at 50 U/mL. In sum, the results show that both rHuPH20 and F204P-PH20 provided a statistically significant increase in the area of dye dispersion compared to the vehicle control.

TABLE 28

Trypan Blue Dispersion

| Group | Area (mm2) | | | | |
|---|---|---|---|---|---|
| Avg. (n = 6) | 2.5 min | 5 min | 10 min | 15 min | 20 min |
| 1: Control | 37.44 ± 2.81 | 38.16 ± 3.33 | 43.71 ± 2.12 | 45.70 ± 2.38 | 48.77 ± 2.14 |
| 2: rHuPH20 (5 U/mL) | 36.68 ± 2.83 | 42.31 ± 2.57 | 45.41 ± 2.75 | 46.72 ± 3.35 | 49.61 ± 2.97 |
| 3: rHuPH20 (50 U/mL) | 39.24 ± 1.20 | 44.90 ± 1.44 | 46.96 ± 1.70 | 50.08 ± 2.07 | 53.50 ± 1.59 |
| 4: rHuPH20 (500 U/mL) | 44.72 ± 1.35 | 50.21 ± 1.92 | 57.47 ± 1.29 | 59.77 ± 1.25 | 57.17 ± 3.28 |
| 5: F204P (5 U/mL) | 39.65 ± 1.53 | 46.09 ± 2.73 | 48.07 ± 1.43 | 52.54 ± 2.01 | 54.11 ± 1.01 |
| 6: F204P (50 U/mL) | 38.10 ± 1.92 | 47.07 ± 2.12 | 51.48 ± 2.14 | 55.24 ± 1.90 | 58.34 ± 2.89 |
| 7: F204P (500 U/mL) | 46.58 ± 1.67 | 54.06 ± 2.52 | 58.96 ± 1.85 | 64.37 ± 1.72 | 64.44 ± 2.17 |

Example 15

Assessment of Enzymatic Activity by Dermal Barrier Reconstitution

Activity of F204P-PH20 was assessed and compared to rHuPH20 to measure the amount of time required for the dermal barrier to reconstitute itself after intradermal hyaluronidase administration. Dermal reconstitution was evaluated by comparing the duration of the hyaluronidase spreading activity as assessed by monitoring the area of diffusion of 0.4% Trypan Blue over time. The proteins used in the study were purified PH20 variant F204P (prepared as described in Example 12) and wild-type rHuPH20 (prepared as described in Example 1) that were both formulated in API buffer (10 mM Histidine, 130 mM NaCl, pH 6.5). Vehicle (API buffer) was used as a control. Male NCr nu/nu homozygous mice were used in the study with three animals per time point for a total of fifteen mice used per group as set forth in Table 29.

TABLE 29

Summary of Treatment Groups for Dermal Barrier Reconstitution Study

| Group | No. of Mice | Time Points (h) | Test Article | Final Dose (Units/mL) | Injection Volume (mL) |
|---|---|---|---|---|---|
| 1 | 15 | 0.5, 1, 4, 24, 48 | Control | 0 | 0.04 |
| 2 | 15 | 0.5, 1, 4, 24, 48 | rHuPH20 | 100 | 0.04 |
| 3 | 15 | 0.5, 1, 4, 24, 48 | F204P | 100 | 0.04 |

All mice received two intradermal doses of vehicle control or rHuPH20 or F204P-PH20 at 100 U/mL in 0.04 mL at study time 0. The same control or test article was injected on the opposing lateral sides of each animal (right, R; left, L). Injection sites were marked with a permanent marker. Trypan Blue Stain (0.4% liquid solution; 15250, Invitrogen) was administered at a volume of 0.04 mL by intradermal injection at the same injection site at 0.5, 1, 4, 24 and 48 hours post-injection of test article or control. At 5 and 20 minutes post-injection of the Trypan Blue Stain, the area of the dye at the injection site was measured by digital imaging of the region as described in Example 14.

The results are set forth in Table 30. The results show that when the area of dye dispersion was measured at various time points after administration of the test article or control, there was a statistically significant increase in the area of dye dispersion at 30 min and 1 hour post-injection of rHuPH20 or F204P-PH20. By 4 hours post-administration of the enzymes, however, there was not a statistically significant increase in the area of dye dispersion compared to control. In addition, no statistically significant differences in the area of dye dispersion was observed between the rHuPH20 and F204P-PH20 treatment groups. Therefore, the duration of the spreading activity of rHuPH20 and F204P were similar and show that rHuPH20 and F204P-PH20 have comparable in vivo performance.

TABLE 30

Dermal Reconstitution

| time Point | min post-injection | Vehicle | rHuPH20 | F204P-PH20 |
|---|---|---|---|---|
| 30 | 5 | 49.96 ± 2.05 | 80.84 ± 8.03 | 80.76 ± 4.46 |
|  | 20 | 64.42 ± 2.49 | 94.55 ± 7.09 | 95.75 ± 5.18 |
| 1 hour | 5 | 58.01 ± 3.21 | 82.56 ± 6.40 | 77.11 ± 3.18 |
|  | 20 | 65.19 ± 6.21 | 96.19 ± 6.39 | 91.45 ± 1.73 |
| 4 hour | 5 | 52.10 ± 3.47 | 67.19 ± 2.39 | 67.33 ± 3.93 |
|  | 20 | 57.69 ± 3.92 | 81.15 ± 4.45 | 82.21 ± 4.14 |
| 24 hour | 5 | 49.87 ± 3.25 | 59.01 ± 2.15 | 54.91 ± 3.54 |
|  | 20 | 57.15 ± 3.47 | 67.65 ± 2.27 | 62.91 ± 3.30 |
| 48 hour | 5 | 53.64 ± 2.99 | 53.53 ± 4.88 | 55.64 ± 7.19 |
|  | 20 | 61.57 ± 4.02 | 66.33 ± 4.12 | 63.11 ± 5.97 |

Example 16

In Vivo Pharmacokinetics of F204P-PH20 Compared to rHuPH20

The pharmacokinetics (PK) of rHuPH20 and F204P-PH20 were compared following intravenous tail-vein administration by measuring the plasma hyaluronidase levels over time after administration. The proteins used in the study were purified PH20 variant F204P (prepared as described in Example 12; batch concentration 1.02 mg/mL) and wild-type rHuPH20 (prepared as described in Example 1; batch concentration 0.95 mg/mL) formulated in API buffer (10 mM Histidine, 130 mM NaCl, pH 6.5). The proteins were prepared at a concentration of 0.087 mg/mL in API buffer for a dose volume of about 5 mL. An animal that was not administered with protein was used a control (pre-dose control). Forty two (42) male CD-1 mice (~20-30 grams) were used in the study with six animals per treatment group as set forth in Table 31.

TABLE 31

Pharmacokinetics of Single Intravenous Dose of rHuPH20 or F204P-PH20

| Group | number of animals (No.) | Test Article | Dose (mg/kg) | Dose Volume (mL/kg) | Euthanasia |
|---|---|---|---|---|---|
| 1 | 6 (Nos. 1-6) | no treatment | N/A | N/A | pre-dose |
| 2 | 6 (Nos. 7-12) | rHuPH20 | 0.433 | 5 | 1 min |
| 3 | 6 (Nos. 13-18) | rHuPH20 | 0.433 | 5 | 5 ± 1 min |
| 4 | 6 (Nos. 19-24) | rHuPH20 | 0.433 | 5 | 10 ± 2 min |
| 5 | 6 (Nos. 25-30) | F204P-PH20 | 0.433 | 5 | 1 min |
| 6 | 6 (Nos. 21-36) | F204P-PH20 | 0.433 | 5 | 5 ± 1 min |
| 7 | 6 (Nos. 37-42) | F204P-PH20 | 0.433 | 5 | 10 ± 2 min |

Mice were intravenously administered 0.433 mg/kg rHuPH20 or F204P-PH20 by tail vein injection. Blood samples were obtained from animals 1 minute, 5 minutes and 10 minutes post-administration. Blood samples were obtained by terminal bleed (cardiac puncture) and collected into blood collection tubes containing the anti-coagulant EDTA for the preparation of plasma. Blood samples were centrifuged at 500 g for 10 minutes and the plasma removed and frozen at −80° C. until assessment of hyaluronidase activity using the microturbidity assay described in Example 8.

The results are set forth in Table 32. The results show that hyaluronidase activity is detected in plasma prior to treatment with the hyaluronidase. Within 1 minute post-treatment with either rHuPH20 or F204P-PH20 hyaluronidase, there is a detectably high amount of hyaluronidase activity present in the plasma, which is similar between both treatment groups. Over time, the hyaluronidase activity rapidly decreases for both treatment groups, although there is detectably hyaluronidase activity present in the plasma 10 minutes post-administration. At the 5 minute and 10 minute post-administration time points, activity in the plasma in animals treated with F204P-PH20 is greater than in animals treated with rHuPH20. This shows that F204P-PH20 exhibits somewhat greater activity for a prolonged time period, and therefore exhibits greater half-life in vivo than rHuPH20.

TABLE 32 rHuPH20 and F204P-PH20 Activity (U/mL) in Mouse Plasma K2EDTA

| | Time Point (min) | | | | | | | |
|---|---|---|---|---|---|---|---|---|
| | Predose | | 1 minute | | 5 minute | | 10 minute | |
| Protein | Animal No. | U/mL | Animal No. | U/mL | Animal No. | U/mL | Animal No. | U/mL |
| rHuPH20 | 1 | BQL | 7 | 235[a] | 13 | 18.3 | 19 | 3.76 |
| | 2 | BQL | 8 | 13.5 | 14 | 7.70 | 20 | 3.70 |
| | 3 | BQL | 9 | 278 | 15 | 8.85 | 21 | 2.64 |
| | 4 | BQL | 10 | 328 | 16 | 10.5 | 22 | 2.70 |
| | 5 | BQL | 11 | 356 | 17 | 12.8 | 23 | 2.36 |
| | 6 | BQL | 12 | 287 | 18 | 18.0 | 24 | 2.80 |
| F204P-PH20 | 1 | BQL | 25 | 249 | 31 | 48.0 | 37 | 11.5 |
| | 2 | BQL | 26 | 223 | 32 | 21.6 | 38 | 11.4 |
| | 3 | BQL | 27 | 246 | 33 | 38.4 | 39 | 10.1 |
| | 4 | BQL | 28 | 246 | 34 | 38.6 | 40 | 12.2 |
| | 5 | BQL | 29 | 0.696 | 35 | 38.2 | 41 | 10.8 |
| | 6 | BQL | 30 | 257 | 36 | 28.5 | 42 | 10.2 |

BQL—Below Quantifiable Limit <0.625 U/mL with minimum required dilution
[a]Hemolyzed

SEQUENCE LISTING (927 sequences)

SEQ ID NO: 1 - DNA, 1413 bp, Homo Sapiens
  human PH20 hyaluronidase encoding 36-482 containing IgG kappa signal sequence
atggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttactgataa

SEQ ID NO: 2 - protein, 469 aa, Homo Sapiens
  Precursor human PH20 hyaluronidase 36-482 containing IgG kappa signal sequence
MDMRVPAQLLGLLLLWLPGARGLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 3 - protein, 447 aa, Homo Sapiens [sequence omitted]

SEQ ID NO: 4 - DNA, 7470 bp, Artificial Sequence
  HZ24-PH20-IRES-SEAP
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttactgataaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgggtcttttctgcagtcaccgtcgtcgacaagcttcctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggttaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 5 - DNA, 6630 bp, Artificial Sequence
  HZ24-DHFR expression vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 6 - protein, 509 aa, Homo Sapiens
  Precursor Full-length human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 7 - protein, 474 aa, Homo Sapiens
  Mature full-length human PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 8 - protein, 510 aa, Pan troglodyte
  Precursor chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 9 - protein, 509 aa, Pan troglodyte
  Precursor chimpanzee PH20
  ref <308>: DATABASE ACCESSION NUMBER: NCBI: XP_527873
  ref <309>: DATABASE ENTRY DATE: 2011-05-13
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 10 - protein, 474 aa, Pan troglodyte
  mature chimpanzee PH20
LNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 11 - protein, 512 aa, Macaca mulatta
  Precursor Rhesus Monkey PH20
  ref <308>: DATABASE ACCESSION NUMBER: GenBank: EHH17639
  ref <309>: DATABASE ENTRY DATE: 2011-11-04
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 12 - protein, 477 aa, Macaca mulatta
  mature Rhesus monkey PH20
LNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 13 - protein, 510 aa, Macaca fascicularis
  Precursor Cynomolgus monkey PH20
  ref <308>: DATABASE ACCESSION NUMBER: UniProtKB: P38568.1
  ref <309>: DATABASE ENTRY DATE: 1994-10-01
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 14 - protein, 475 aa, Macaca fascicularis
  mature Cynomolgus monkey PH20
  ref <308>: DATABASE ACCESSION NUMBER: UniProtKB: P38568.1
  ref <309>: DATABASE ENTRY DATE: 1994-10-01
LNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 15 - protein, 553 aa, Bos taurus
  Precursor cow PH20
  ref <308>: DATABASE ACCESSION NUMBER: GenBank: AAI10184.1
  ref <309>: DATABASE ENTRY DATE: 2009-03-18
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 16 - protein, 518 aa, Bos taurus
  Mature cow PH20
LDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 17 - protein, 474 aa, Bos taurus
  Precursor cow PH20
  ref <308>: DATABASE ACCESSION NUMBER: GenBank: AAP55713
  ref <309>: DATABASE ENTRY DATE: 2003-06-11
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 18 - protein, 439 aa, Bos taurus
  mature cow PH20
LDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 19 - protein, 512 aa, Mus musculus
  Precursor mouse PH20
  ref <308>: DATABASE ACCESSION NUMBER: NCBI: NP_001073344.1
  ref <309>: DATABASE ENTRY DATE: 2012-12-12
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 20 - protein, 477 aa, Mus musculus
  Mature mouse PH20
VDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 21 - protein, 512 aa, Rattus norvegicus
  Precursor rat PH20
  ref <308>: DATABASE ACCESSION NUMBER: NCBI: NP_446419.1
  ref <309>: DATABASE ENTRY DATE: 2012-08-30
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 22 - protein, 477 aa, Rattus norvegicus
  Mature rat PH20
VDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 23 - protein, 545 aa, Oryctolagus cuniculus
  Precursor rabbit PH20
  ref <308>: DATABASE ACCESSION NUMBER: NCBI: NP_001076141.1
  ref <309>: DATABASE ENTRY DATE: 2012-10-06
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 24 - protein, 510 aa, Oryctolagus cuniculus
  Mature rabbit PH20
ANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 25 - protein, 114 aa, Ovis aries
  Sheep PH20
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 26 - protein, 520 aa, Ovis aries
  Sheep PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 27 - protein, 517 aa, Ovis aries
  Sheep PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 28 - protein, 529 aa, Cavia porcellus
  Precursor guinea pig PH20
  ref <308>: DATABASE ACCESSION NUMBER: NCBI: NP_001166492.1
  ref <309>: DATABASE ENTRY DATE: 2012-11-17
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 29 - protein, 494 aa, Cavia porcellus
  mature guinea pig PH20
  ref <308>: DATABASE ACCESSION NUMBER: NCBI: NP_001166492.1
  ref <309>: DATABASE ENTRY DATE: 2012-11-17
DKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 30 - protein, 540 aa, Vulpes vulpes
  Precursor Red Fox PH20
  ref <308>: DATABASE ACCESSION NUMBER: UniProtKB: Q29152
  ref <309>: DATABASE ENTRY DATE: 2006-11-28
MGVLRFQNIFFRSFLGSSGTTQAVFIFLLIPRCLTQEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 31 - protein, 505 aa, Vulpes vulpes
  Mature Red Fox PH20
QEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 32 - protein, 430 aa, Homo sapiens
  Mature human PH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 33 - protein, 431 aa, Homo Sapiens
  mature human PH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 34 - protein, 432 aa, Homo sapiens
  mature human PH20 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 35 - protein, 433 aa, Homo Sapiens
  mature human PH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 36 - protein, 434 aa, Homo Sapiens
  mature PH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 37 - protein, 435 aa, Homo Sapiens
  mature human PH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 38 - protein, 436 aa, Homo Sapiens
  mature human PH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 39 - protein, 437 aa, Homo Sapiens
  mature human PH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 40 - protein, 438 aa, Homo Sapiens
  mature human PH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 41 - protein, 439 aa, Homo Sapiens
  mature human PH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 42 - protein, 440 aa, Homo Sapiens
  mature human PH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 43 - protein, 441 aa, Homo Sapiens
  mature human PH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 44 - protein, 442 aa, Homo sapiens
  mature human PH20 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 45 - protein, 443 aa, Homo sapiens
  mature human PH20 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 46 - protein, 444 aa, Homo Sapiens
  mature human PH20 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 47 - protein, 445 aa, Homo sapiens
  mature human PH20 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 48 - protein, 446 aa, Homo Sapiens
  mature human PH20 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 49 - protein, 448 aa, Homo sapiens
  mature human PH20 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 50 - protein, 449 aa, Homo sapiens
  mature human PH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 51 - protein, 450 aa, Homo Sapiens
  mature human PH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 52 - protein, 451 aa, Homo Sapiens
  mature human PH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 53 - protein, 452 aa, Homo Sapiens
  mature human PH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 54 - protein, 453 aa, Homo Sapiens
  mature human PH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 55 - protein, 454 aa, Homo Sapiens
  mature human PH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 56 - protein, 455 aa, Homo Sapiens
  mature human PH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 57 - protein, 456 aa, Homo Sapiens
  mature human PH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 58 - protein, 457 aa, Homo Sapiens
  mature human PH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 59 - protein, 458 aa, Homo Sapiens
  mature human PH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 60 - protein, 459 aa, Homo Sapiens
  mature human PH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 61 - protein, 460 aa, Homo Sapiens
  mature human PH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 62 - protein, 461 aa, Homo sapiens
  mature human PH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 63 - protein, 462 aa, Homo Sapiens
  mature human PH30 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 64 - protein, 463 aa, Homo sapiens
  mature human PH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 65 - protein, 464 aa, Homo Sapiens
  mature human PH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 66 - protein, 465 aa, Homo Sapiens
  mature human PH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 67 - DNA, 1446 bp, Homo Sapiens
  DNA encoding PH20 1-482
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 68 - protein, 509 aa, Homo Sapiens [sequence omitted]

SEQ ID NO: 69 - protein, 474 aa, Homo Sapiens
  mature human PH20 Ala13 and Trp464
LNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 70 - protein, 509 aa, Homo sapiens
  Precursor PH20 Gln5
MGVLQFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 71 - protein, 509 aa, Homo Sapiens
  Precursor PH20 Ala47
MGVLKFKHIFFRSFVKSSGVSQIVFTFLLIPCCLTLNFRAPPVIPNAPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 72 - protein, 474 aa, Homo Sapiens
  mature PH20 Ala12
LNFRAPPVIPNAPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 73 - protein, 447 aa, Artificial Sequence
  Mature PH20 36-482 with H at a position corresponding to amino acid residue 1
HNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 74 - protein, 447 aa, Artificial Sequence
  Mature PH20 36-482 with A at a position corresponding to amino acid residue 1
ANFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 75 - protein, 447 aa, Artificial Sequence
  Mature PH20 36-482 with E at a position corresponding to amino acid residue 1
ENFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 76 - protein, 447 aa, Artificial Sequence
  Mature PH20 36-482 with G at a position corresponding to amino acid residue 1
GNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 77 - protein, 447 aa, Artificial Sequence
  Mature PH20 36-482 with K at a position corresponding to amino acid residue 1
KNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 78 - protein, 447 aa, Artificial Sequence
  Mature PH20 36-482 with Q at a position corresponding to amino acid residue 1
QNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 79 - protein, 447 aa, Artificial Sequence
  Mature PH20 36-482 with R at a position corresponding to amino acid residue 1
RNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 80 - protein, 447 aa, Artificial Sequence
  Mature PH20 36-482 with A at a position corresponding to amino acid residue 6
LNFRAAPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 81 - protein, 447 aa, Artificial Sequence
  Mature PH20 36-482 with M at a position corresponding to amino acid residue 8
LNFRAPPMIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 82 - protein, 447 aa, Artificial Sequence
  Mature PH20 36-482 with Q at a position corresponding to amino acid residue 9
LNFRAPPVQPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 83 - protein, 447 aa, Artificial Sequence
  Mature PH20 36-482 with G at a position corresponding to amino acid residue 10
LNFRAPPVIGNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 84 - protein, 447 aa, Artificial Sequence
  Mature PH20 36-482 with H at a position corresponding to amino acid residue 10
LNFRAPPVIHNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 85 - protein, 447 aa, Artificial Sequence
  Mature PH20 36-482 with S at a position corresponding to amino acid residue 11
LNFRAPPVIPSVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 86 - protein, 447 aa, Artificial Sequence
  Mature PH20 36-482 with E at a position corresponding to amino acid residue 12
LNFRAPPVIPNEPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 87 - protein, 447 aa, Artificial Sequence
  Mature PH20 36-482 with I at a position corresponding to amino acid residue 12
LNFRAPPVIPNIPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 88 - protein, 447 aa, Artificial Sequence
  Mature PH20 36-482 with K at a position corresponding to amino acid residue 12
LNFRAPPVIPNKPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 89 - protein, 447 aa, Artificial Sequence
  Mature PH20 36-482 with T at a position corresponding to amino acid residue 12
LNFRAPPVIPNTPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 90 - protein, 447 aa, Artificial Sequence
  Mature PH20 36-482 with V at a position corresponding to amino acid residue 14
LNFRAPPVIPNVPVLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 91 - protein, 447 aa, Artificial Sequence
  Mature PH20 36-482 with V at a position corresponding to amino acid residue 15
LNFRAPPVIPNVPFVWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 92 - protein, 447 aa, Artificial Sequence
  Mature PH20 36-482 with M at a position corresponding to amino acid residue 15
LNFRAPPVIPNVPFMWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 93 - protein, 447 aa, Artificial Sequence
  Mature PH20 36-482 with S at a position corresponding to amino acid residue 20
LNFRAPPVIPNVPFLWAWNSPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 94 - protein, 447 aa, Artificial Sequence
  Mature PH20 36-482 with T at a position corresponding to amino acid residue 22
LNFRAPPVIPNVPFLWAWNAPTEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 95 - protein, 447 aa, Artificial Sequence
  Mature PH20 36-482 with E at a position corresponding to amino acid residue 24
LNFRAPPVIPNVPFLWAWNAPSEECLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 96 - protein, 447 aa, Artificial Sequence
  Mature PH20 36-482 with H at a position corresponding to amino acid residue 24
LNFRAPPVIPNVPFLWAWNAPSEHCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 97 - protein, 447 aa, Artificial Sequence
  Mature PH20 36-482 with R at a position corresponding to amino acid residue 24
LNFRAPPVIPNVPFLWAWNAPSERCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 98 - protein, 447 aa, Artificial Sequence
  Mature PH20 36-482 with A at a position corresponding to amino acid residue 26
LNFRAPPVIPNVPFLWAWNAPSEFCAGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 99 - protein, 447 aa, Artificial Sequence
  Mature PH20 36-482 with E at a position corresponding to amino acid residue 26
LNFRAPPVIPNVPFLWAWNAPSEFCEGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 100 - protein, 447 aa, Artificial Sequence
  Mature PH20 36-482 with K at a position corresponding to amino acid residue 26
LNFRAPPVIPNVPFLWAWNAPSEFCKGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 101 - protein, 447 aa, Artificial Sequence
  Mature PH20 36-482 with M at a position corresponding to amino acid residue 26
LNFRAPPVIPNVPFLWAWNAPSEFCMGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 102 - protein, 447 aa, Artificial Sequence
  Mature PH20 36-482 with Q at a position corresponding to amino acid residue 26
LNFRAPPVIPNVPFLWAWNAPSEFCQGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 103 - protein, 447 aa, Artificial Sequence
  Mature PH20 36-482 with R at a position corresponding to amino acid residue 26
LNFRAPPVIPNVPFLWAWNAPSEFCRGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 104 - protein, 447 aa, Artificial Sequence
  Mature PH20 36-482 with D at a position corresponding to amino acid residue 27
LNFRAPPVIPNVPFLWAWNAPSEFCLDKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 105 - protein, 447 aa, Artificial Sequence
  Mature PH20 36-482 with K at a position corresponding to amino acid residue 27
LNFRAPPVIPNVPFLWAWNAPSEFCLKKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 106 - protein, 447 aa, Artificial Sequence
  Mature PH20 36-482 with R at a position corresponding to amino acid residue 27
LNFRAPPVIPNVPFLWAWNAPSEFCLRKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 107 - protein, 447 aa, Artificial Sequence
  Mature PH20 36-482 with R at a position corresponding to amino acid residue 28
LNFRAPPVIPNVPFLWAWNAPSEFCLGRFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 108 - protein, 447 aa, Artificial Sequence
  Mature PH20 36-482 with E at a position corresponding to amino acid residue 29
LNFRAPPVIPNVPFLWAWNAPSEFCLGKEDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 109 - protein, 447 aa, Artificial Sequence
  Mature PH20 36-482 with I at a position corresponding to amino acid residue 29
LNFRAPPVIPNVPFLWAWNAPSEFCLGKIDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 110 - protein, 447 aa, Artificial Sequence
  Mature PH20 36-482 with K at a position corresponding to amino acid residue 29
LNFRAPPVIPNVPFLWAWNAPSEFCLGKKDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 111 - protein, 447 aa, Artificial Sequence
  Mature PH20 36-482 with L at a position corresponding to amino acid residue 29
LNFRAPPVIPNVPFLWAWNAPSEFCLGKLDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 112 - protein, 447 aa, Artificial Sequence
  Mature PH20 36-482 with M at a position corresponding to amino acid residue 29
LNFRAPPVIPNVPFLWAWNAPSEFCLGKMDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 113 - protein, 447 aa, Artificial Sequence
  Mature PH20 36-482 with P at a position corresponding to amino acid residue 29
LNFRAPPVIPNVPFLWAWNAPSEFCLGKPDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 114 - protein, 447 aa, Artificial Sequence
  Mature PH20 36-482 with R at a position corresponding to amino acid residue 29
LNFRAPPVIPNVPFLWAWNAPSEFCLGKRDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 115 - protein, 447 aa, Artificial Sequence
  Mature PH20 36-482 with S at a position corresponding to amino acid residue 29
LNFRAPPVIPNVPFLWAWNAPSEFCLGKSDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 116 - protein, 447 aa, Artificial Sequence
  Mature PH20 36-482 with T at a position corresponding to amino acid residue 29
LNFRAPPVIPNVPFLWAWNAPSEFCLGKTDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 117 - protein, 447 aa, Artificial Sequence
  Mature PH20 36-482 with V at a position corresponding to amino acid residue 29
LNFRAPPVIPNVPFLWAWNAPSEFCLGKVDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 118 - protein, 447 aa, Artificial Sequence
  Mature PH20 36-482 with G at a position corresponding to amino acid residue 30
LNFRAPPVIPNVPFLWAWNAPSEFCLGKFGEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 119 - protein, 447 aa, Artificial Sequence
  Mature PH20 36-482 with H at a position corresponding to amino acid residue 30
LNFRAPPVIPNVPFLWAWNAPSEFCLGKFHEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 120 - protein, 447 aa, Artificial Sequence
  Mature PH20 36-482 with K at a position corresponding to amino acid residue 30
LNFRAPPVIPNVPFLWAWNAPSEFCLGKFKEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 121 - protein, 447 aa, Artificial Sequence
  Mature PH20 36-482 with L at a position corresponding to amino acid residue 30
LNFRAPPVIPNVPFLWAWNAPSEFCLGKFLEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 122 - protein, 447 aa, Artificial Sequence
  Mature PH20 36-482 with M at a position corresponding to amino acid residue 30
LNFRAPPVIPNVPFLWAWNAPSEFCLGKFMEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 123 - protein, 447 aa, Artificial Sequence
  Mature PH20 36-482 with R at a position corresponding to amino acid residue 30
LNFRAPPVIPNVPFLWAWNAPSEFCLGKFREPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 124 - protein, 447 aa, Artificial Sequence
  Mature PH20 36-482 with S at a position corresponding to amino acid residue 30
LNFRAPPVIPNVPFLWAWNAPSEFCLGKFSEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 125 - protein, 447 aa, Artificial Sequence
  Mature PH20 36-482 with A at a position corresponding to amino acid residue 31
LNFRAPPVIPNVPFLWAWNAPSEFCLGKFDAPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 126 - protein, 447 aa, Artificial Sequence
  Mature PH20 36-482 with C at a position corresponding to amino acid residue 31
LNFRAPPVIPNVPFLWAWNAPSEFCLGKFDCPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 127 - protein, 447 aa, Artificial Sequence
  Mature PH20 36-482 with G at a position corresponding to amino acid residue 31
LNFRAPPVIPNVPFLWAWNAPSEFCLGKFDGPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 128 - protein, 447 aa, Artificial Sequence
  Mature PH20 36-482 with H at a position corresponding to amino acid residue 31
LNFRAPPVIPNVPFLWAWNAPSEFCLGKFDHPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 129 - protein, 447 aa, Artificial Sequence
  Mature PH20 36-482 with I at a position corresponding to amino acid residue 31
LNFRAPPVIPNVPFLWAWNAPSEFCLGKFDIPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 130 - protein, 447 aa, Artificial Sequence
  Mature PH20 36-482 with K at a position corresponding to amino acid residue 31
LNFRAPPVIPNVPFLWAWNAPSEFCLGKFDKPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 131 - protein, 447 aa, Artificial Sequence
  Mature PH20 36-482 with L at a position corresponding to amino acid residue 31
LNFRAPPVIPNVPFLWAWNAPSEFCLGKFDLPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 132 - protein, 447 aa, Artificial Sequence
  Mature PH20 36-482 with P at a position corresponding to amino acid residue 31
LNFRAPPVIPNVPFLWAWNAPSEFCLGKFDPPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 133 - protein, 447 aa, Artificial Sequence
  Mature PH20 36-482 with R at a position corresponding to amino acid residue 31
LNFRAPPVIPNVPFLWAWNAPSEFCLGKFDRPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 134 - protein, 447 aa, Artificial Sequence
  Mature PH20 36-482 with S at a position corresponding to amino acid residue 31
LNFRAPPVIPNVPFLWAWNAPSEFCLGKFDSPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 135 - protein, 447 aa, Artificial Sequence
  Mature PH20 36-482 with T at a position corresponding to amino acid residue 31
LNFRAPPVIPNVPFLWAWNAPSEFCLGKFDTPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 136 - protein, 447 aa, Artificial Sequence
  Mature PH20 36-482 with V at a position corresponding to amino acid residue 31
LNFRAPPVIPNVPFLWAWNAPSEFCLGKFDVPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 137 - protein, 447 aa, Artificial Sequence
  Mature PH20 36-482 with W at a position corresponding to amino acid residue 31
LNFRAPPVIPNVPFLWAWNAPSEFCLGKFDWPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 138 - protein, 447 aa, Artificial Sequence
  Mature PH20 36-482 with C at a position corresponding to amino acid residue 32
LNFRAPPVIPNVPFLWAWNAPSEFCLGKFDECLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 139 - protein, 447 aa, Artificial Sequence
  Mature PH20 36-482 with F at a position corresponding to amino acid residue 32
LNFRAPPVIPNVPFLWAWNAPSEFCLGKFDEFLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 140 - protein, 447 aa, Artificial Sequence
  Mature PH20 36-482 with G at a position corresponding to amino acid residue 32
LNFRAPPVIPNVPFLWAWNAPSEFCLGKFDEGLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 141 - protein, 447 aa, Artificial Sequence
  Mature PH20 36-482 with H at a position corresponding to amino acid residue 32
LNFRAPPVIPNVPFLWAWNAPSEFCLGKFDEHLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 142 - protein, 447 aa, Artificial Sequence
  Mature PH20 36-482 with W at a position corresponding to amino acid residue 33
LNFRAPPVIPNVPFLWAWNAPSEFCLGKFDEPWDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 143 - protein, 447 aa, Artificial Sequence
  Mature PH20 36-482 with G at a position corresponding to amino acid residue 33
LNFRAPPVIPNVPFLWAWNAPSEFCLGKFDEPGDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 144 - protein, 447 aa, Artificial Sequence
  Mature PH20 36-482 with W at a position corresponding to amino acid residue 34
LNFRAPPVIPNVPFLWAWNAPSEFCLGKFDEPLWMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 145 - protein, 447 aa, Artificial Sequence
  Mature PH20 36-482 with Q at a position corresponding to amino acid residue 35
LNFRAPPVIPNVPFLWAWNAPSEFCLGKFDEPLDQSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 146 - protein, 447 aa, Artificial Sequence
  Mature PH20 36-482 with V at a position corresponding to amino acid residue 35
LNFRAPPVIPNVPFLWAWNAPSEFCLGKFDEPLDVSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 147 - protein, 447 aa, Artificial Sequence
  Mature PH20 36-482 with H at a position corresponding to amino acid residue 36
LNFRAPPVIPNVPFLWAWNAPSEFCLGKFDEPLDMHLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 148 - protein, 447 aa, Artificial Sequence
  Mature PH20 36-482 with N at a position corresponding to amino acid residue 36
LNFRAPPVIPNVPFLWAWNAPSEFCLGKFDEPLDMNLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 149 - protein, 447 aa, Artificial Sequence
  Mature PH20 36-482 with F at a position corresponding to amino acid residue 37
LNFRAPPVIPNVPFLWAWNAPSEFCLGKFDEPLDMSFFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 150 - protein, 447 aa, Artificial Sequence
  Mature PH20 36-482 with M at a position corresponding to amino acid residue 37
LNFRAPPVIPNVPFLWAWNAPSEFCLGKFDEPLDMSMFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 151 - protein, 447 aa, Artificial Sequence
  Mature PH20 36-482 with Y at a position corresponding to amino acid residue 38
LNFRAPPVIPNVPFLWAWNAPSEFCLGKFDEPLDMSLYSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 152 - protein, 447 aa, Artificial Sequence
  Mature PH20 36-482 with A at a position corresponding to amino acid residue 39
LNFRAPPVIPNVPFLWAWNAPSEFCLGKFDEPLDMSLFAFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 153 - protein, 447 aa, Artificial Sequence
  Mature PH20 36-482 with L at a position corresponding to amino acid residue 39
LNFRAPPVIPNVPFLWAWNAPSEFCLGKFDEPLDMSLFLFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 154 - protein, 447 aa, Artificial Sequence
  Mature PH20 36-482 with N at a position corresponding to amino acid residue 39
LNFRAPPVIPNVPFLWAWNAPSEFCLGKFDEPLDMSLFNFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 155 - protein, 447 aa, Artificial Sequence
  Mature PH20 36-482 with T at a position corresponding to amino acid residue 39
LNFRAPPVIPNVPFLWAWNAPSEFCLGKFDEPLDMSLFTFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 156 - protein, 447 aa, Artificial Sequence
  Mature PH20 36-482 with L at a position corresponding to amino acid residue 40
LNFRAPPVIPNVPFLWAWNAPSEFCLGKFDEPLDMSLFSLIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 157 - protein, 447 aa, Artificial Sequence
  Mature PH20 36-482 with T at a position corresponding to amino acid residue 41
LNFRAPPVIPNVPFLWAWNAPSEFCLGKFDEPLDMSLFSFTGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 158 - protein, 447 aa, Artificial Sequence
  Mature PH20 36-482 with L at a position corresponding to amino acid residue 46
LNFRAPPVIPNVPFLWAWNAPSEFCLGKFDEPLDMSLFSFIGSPRLNATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 159 - protein, 447 aa, Artificial Sequence
  Mature PH20 36-482 with R at a position corresponding to amino acid residue 46
LNFRAPPVIPNVPFLWAWNAPSEFCLGKFDEPLDMSLFSFIGSPRRNATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 160 - protein, 447 aa, Artificial Sequence
  Mature PH20 36-482 with D at a position corresponding to amino acid residue 47
LNFRAPPVIPNVPFLWAWNAPSEFCLGKFDEPLDMSLFSFIGSPRIDATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 161 - protein, 447 aa, Artificial Sequence
  Mature PH20 36-482 with F at a position corresponding to amino acid residue 47
LNFRAPPVIPNVPFLWAWNAPSEFCLGKFDEPLDMSLFSFIGSPRIFATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 162 - protein, 447 aa, Artificial Sequence
  Mature PH20 36-482 with T at a position corresponding to amino acid residue 47
LNFRAPPVIPNVPFLWAWNAPSEFCLGKFDEPLDMSLFSFIGSPRITATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 163 - protein, 447 aa, Artificial Sequence
  Mature PH20 36-482 with W at a position corresponding to amino acid residue 47
LNFRAPPVIPNVPFLWAWNAPSEFCLGKFDEPLDMSLFSFIGSPRIWATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 164 - protein, 447 aa, Artificial Sequence
  Mature PH20 36-482 with F at a position corresponding to amino acid residue 48
LNFRAPPVIPNVPFLWAWNAPSEFCLGKFDEPLDMSLFSFIGSPRINFTGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 165 - protein, 447 aa, Artificial Sequence
  Mature PH20 36-482 with H at a position corresponding to amino acid residue 48
LNFRAPPVIPNVPFLWAWNAPSEFCLGKFDEPLDMSLFSFIGSPRINHTGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 166 - protein, 447 aa, Artificial Sequence
  Mature PH20 36-482 with K at a position corresponding to amino acid residue 48
LNFRAPPVIPNVPFLWAWNAPSEFCLGKFDEPLDMSLFSFIGSPRINKTGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 167 - protein, 447 aa, Artificial Sequence
  Mature PH20 36-482 with N at a position corresponding to amino acid residue 48
LNFRAPPVIPNVPFLWAWNAPSEFCLGKFDEPLDMSLFSFIGSPRINNTGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 168 - protein, 447 aa, Artificial Sequence
  Mature PH20 36-482 with R at a position corresponding to amino acid residue 49
LNFRAPPVIPNVPFLWAWNAPSEFCLGKFDEPLDMSLFSFIGSPRINARGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 169 - protein, 447 aa, Artificial Sequence
  Mature PH20 36-482 with D at a position corresponding to amino acid residue 50
LNFRAPPVIPNVPFLWAWNAPSEFCLGKFDEPLDMSLFSFIGSPRINATDQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 170 - protein, 447 aa, Artificial Sequence
  Mature PH20 36-482 with S at a position corresponding to amino acid residue 50
LNFRAPPVIPNVPFLWAWNAPSEFCLGKFDEPLDMSLFSFIGSPRINATSQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 171 - protein, 447 aa, Artificial Sequence
  Mature PH20 36-482 with M at a position corresponding to amino acid residue 50
LNFRAPPVIPNVPFLWAWNAPSEFCLGKFDEPLDMSLFSFIGSPRINATMQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 172 - protein, 447 aa, Artificial Sequence
  Mature PH20 36-482 with N at a position corresponding to amino acid residue 52
LNFRAPPVIPNVPFLWAWNAPSEFCLGKFDEPLDMSLFSFIGSPRINATGQNVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 173 - protein, 447 aa, Artificial Sequence
  Mature PH20 36-482 with Q at a position corresponding to amino acid residue 52
LNFRAPPVIPNVPFLWAWNAPSEFCLGKFDEPLDMSLFSFIGSPRINATGQQVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 174 - protein, 447 aa, Artificial Sequence
  Mature PH20 36-482 with R at a position corresponding to amino acid residue 52
LNFRAPPVIPNVPFLWAWNAPSEFCLGKFDEPLDMSLFSFIGSPRINATGQRVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 175 - protein, 447 aa, Artificial Sequence
  Mature PH20 36-482 with S at a position corresponding to amino acid residue 52
LNFRAPPVIPNVPFLWAWNAPSEFCLGKFDEPLDMSLFSFIGSPRINATGQSVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 176 - protein, 447 aa, Artificial Sequence
  Mature PH20 36-482 with T at a position corresponding to amino acid residue 52
LNFRAPPVIPNVPFLWAWNAPSEFCLGKFDEPLDMSLFSFIGSPRINATGQTVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 177 - protein, 447 aa, Artificial Sequence
  Mature PH20 36-482 with C at a position corresponding to amino acid residue 58
LNFRAPPVIPNVPFLWAWNAPSEFCLGKFDEPLDMSLFSFIGSPRINATGQGVTIFYCDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 178 - protein, 447 aa, Artificial Sequence
  Mature PH20 36-482 with K at a position corresponding to amino acid residue 58
LNFRAPPVIPNVPFLWAWNAPSEFCLGKFDEPLDMSLFSFIGSPRINATGQGVTIFYKDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 179 - protein, 447 aa, Artificial Sequence
  Mature PH20 36-482 with L at a position corresponding to amino acid residue 58
LNFRAPPVIPNVPFLWAWNAPSEFCLGKFDEPLDMSLFSFIGSPRINATGQGVTIFYLDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 180 - protein, 447 aa, Artificial Sequence
  Mature PH20 36-482 with P at a position corresponding to amino acid residue 58
LNFRAPPVIPNVPFLWAWNAPSEFCLGKFDEPLDMSLFSFIGSPRINATGQGVTIFYPDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 181 - protein, 447 aa, Artificial Sequence
  Mature PH20 36-482 with Q at a position corresponding to amino acid residue 58
LNFRAPPVIPNVPFLWAWNAPSEFCLGKFDEPLDMSLFSFIGSPRINATGQGVTIFYQDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 182 - protein, 447 aa, Artificial Sequence
  Mature PH20 36-482 with R at a position corresponding to amino acid residue 58
LNFRAPPVIPNVPFLWAWNAPSEFCLGKFDEPLDMSLFSFIGSPRINATGQGVTIFYRDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 183 - protein, 447 aa, Artificial Sequence
  Mature PH20 36-482 with H at a position corresponding to amino acid residue 58
LNFRAPPVIPNVPFLWAWNAPSEFCLGKFDEPLDMSLFSFIGSPRINATGQGVTIFYHDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 184 - protein, 447 aa, Artificial Sequence
  Mature PH20 36-482 with N at a position corresponding to amino acid residue 58
LNFRAPPVIPNVPFLWAWNAPSEFCLGKFDEPLDMSLFSFIGSPRINATGQGVTIFYNDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 185 - protein, 447 aa, Artificial Sequence
  Mature PH20 36-482 with Y at a position corresponding to amino acid residue 58
LNFRAPPVIPNVPFLWAWNAPSEFCLGKFDEPLDMSLFSFIGSPRINATGQGVTIFYYDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 186 - protein, 447 aa, Artificial Sequence
  Mature PH20 36-482 with N at a position corresponding to amino acid residue 59
LNFRAPPVIPNVPFLWAWNAPSEFCLGKFDEPLDMSLFSFIGSPRINATGQGVTIFYVNRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 187 - protein, 447 aa, Artificial Sequence
  Mature PH20 36-482 with K at a position corresponding to amino acid residue 63
LNFRAPPVIPNVPFLWAWNAPSEFCLGKFDEPLDMSLFSFIGSPRINATGQGVTIFYVDRLGKYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 188 - protein, 447 aa, Artificial Sequence
  Mature PH20 36-482 with L at a position corresponding to amino acid residue 63
LNFRAPPVIPNVPFLWAWNAPSEFCLGKFDEPLDMSLFSFIGSPRINATGQGVTIFYVDRLGLYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 189 - protein, 447 aa, Artificial Sequence
  Mature PH20 36-482 with M at a position corresponding to amino acid residue 63
LNFRAPPVIPNVPFLWAWNAPSEFCLGKFDEPLDMSLFSFIGSPRINATGQGVTIFYVDRLGMYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 190 - protein, 447 aa, Artificial Sequence
  Mature PH20 36-482 with R at a position corresponding to amino acid residue 63
LNFRAPPVIPNVPFLWAWNAPSEFCLGKFDEPLDMSLFSFIGSPRINATGQGVTIFYVDRLGRYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 191 - protein, 447 aa, Artificial Sequence
  Mature PH20 36-482 with W at a position corresponding to amino acid residue 63
LNFRAPPVIPNVPFLWAWNAPSEFCLGKFDEPLDMSLFSFIGSPRINATGQGVTIFYVDRLGWYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 192 - protein, 447 aa, Artificial Sequence
  Mature PH20 36-482 with V at a position corresponding to amino acid residue 67
LNFRAPPVIPNVPFLWAWNAPSEFCLGKFDEPLDMSLFSFIGSPRINATGQGVTIFYVDRLGYYPYVDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 193 - protein, 447 aa, Artificial Sequence
  Mature PH20 36-482 with H at a position corresponding to amino acid residue 68
LNFRAPPVIPNVPFLWAWNAPSEFCLGKFDEPLDMSLFSFIGSPRINATGQGVTIFYVDRLGYYPYIHSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 194 - protein, 447 aa, Artificial Sequence
  Mature PH20 36-482 with P at a position corresponding to amino acid residue 68
LNFRAPPVIPNVPFLWAWNAPSEFCLGKFDEPLDMSLFSFIGSPRINATGQGVTIFYVDRLGYYPYIPSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 195 - protein, 447 aa, Artificial Sequence
  Mature PH20 36-482 with Q at a position corresponding to amino acid residue 68
LNFRAPPVIPNVPFLWAWNAPSEFCLGKFDEPLDMSLFSFIGSPRINATGQGVTIFYVDRLGYYPYIQSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 196 - protein, 447 aa, Artificial Sequence
  Mature PH20 36-482 with A at a position corresponding to amino acid residue 69
LNFRAPPVIPNVPFLWAWNAPSEFCLGKFDEPLDMSLFSFIGSPRINATGQGVTIFYVDRLGYYPYIDAITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 197 - protein, 447 aa, Artificial Sequence
  Mature PH20 36-482 with C at a position corresponding to amino acid residue 69
LNFRAPPVIPNVPFLWAWNAPSEFCLGKFDEPLDMSLFSFIGSPRINATGQGVTIFYVDRLGYYPYIDCITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 198 - protein, 447 aa, Artificial Sequence
  Mature PH20 36-482 with E at a position corresponding to amino acid residue 69
LNFRAPPVIPNVPFLWAWNAPSEFCLGKFDEPLDMSLFSFIGSPRINATGQGVTIFYVDRLGYYPYIDEITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 199 - protein, 447 aa, Artificial Sequence
  Mature PH20 36-482 with F at a position corresponding to amino acid residue 69
LNFRAPPVIPNVPFLWAWNAPSEFCLGKFDEPLDMSLFSFIGSPRINATGQGVTIFYVDRLGYYPYIDFITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 200 - protein, 447 aa, Artificial Sequence
  Mature PH20 36-482 with G at a position corresponding to amino acid residue 69
LNFRAPPVIPNVPFLWAWNAPSEFCLGKFDEPLDMSLFSFIGSPRINATGQGVTIFYVDRLGYYPYIDGITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 201 - protein, 447 aa, Artificial Sequence
  Mature PH20 36-482 with I at a position corresponding to amino acid residue 69
LNFRAPPVIPNVPFLWAWNAPSEFCLGKFDEPLDMSLFSFIGSPRINATGQGVTIFYVDRLGYYPYIDIITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 202 - protein, 447 aa, Artificial Sequence
  Mature PH20 36-482 with L at a position corresponding to amino acid residue 69
LNFRAPPVIPNVPFLWAWNAPSEFCLGKFDEPLDMSLFSFIGSPRINATGQGVTIFYVDRLGYYPYIDLITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 203 - protein, 447 aa, Artificial Sequence
  Mature PH20 36-482 with M at a position corresponding to amino acid residue 69
LNFRAPPVIPNVPFLWAWNAPSEFCLGKFDEPLDMSLFSFIGSPRINATGQGVTIFYVDRLGYYPYIDMITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 204 - protein, 447 aa, Artificial Sequence
  Mature PH20 36-482 with P at a position corresponding to amino acid residue 69;
LNFRAPPVIPNVPFLWAWNAPSEFCLGKFDEPLDMSLFSFIGSPRINATGQGVTIFYVDRLGYYPYIDPITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 205 - protein, 447 aa, Artificial Sequence
  Mature PH20 36-482 with R at a position corresponding to amino acid residue 69
LNFRAPPVIPNVPFLWAWNAPSEFCLGKFDEPLDMSLFSFIGSPRINATGQGVTIFYVDRLGYYPYIDRITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 206 - protein, 447 aa, Artificial Sequence
  Mature PH20 36-482 with T at a position corresponding to amino acid residue 69
LNFRAPPVIPNVPFLWAWNAPSEFCLGKFDEPLDMSLFSFIGSPRINATGQGVTIFYVDRLGYYPYIDTITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 207 - protein, 447 aa, Artificial Sequence
  Mature PH20 36-482 with W at a position corresponding to amino acid residue 69
LNFRAPPVIPNVPFLWAWNAPSEFCLGKFDEPLDMSLFSFIGSPRINATGQGVTIFYVDRLGYYPYIDWITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 208 - protein, 447 aa, Artificial Sequence
  Mature PH20 36-482 with Y at a position corresponding to amino acid residue 69
LNFRAPPVIPNVPFLWAWNAPSEFCLGKFDEPLDMSLFSFIGSPRINATGQGVTIFYVDRLGYYPYIDYITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 209 - protein, 447 aa, Artificial Sequence
  Mature PH20 36-482 with A at a position corresponding to amino acid residue 70
LNFRAPPVIPNVPFLWAWNAPSEFCLGKFDEPLDMSLFSFIGSPRINATGQGVTIFYVDRLGYYPYIDSATGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 210 - protein, 447 aa, Artificial Sequence
  Mature PH20 36-482 with C at a position corresponding to amino acid residue 70
LNFRAPPVIPNVPFLWAWNAPSEFCLGKFDEPLDMSLFSFIGSPRINATGQGVTIFYVDRLGYYPYIDSCTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 211 - protein, 447 aa, Artificial Sequence
  Mature PH20 36-482 with F at a position corresponding to amino acid residue 70
LNFRAPPVIPNVPFLWAWNAPSEFCLGKFDEPLDMSLFSFIGSPRINATGQGVTIFYVDRLGYYPYIDSFTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 212 - protein, 447 aa, Artificial Sequence
  Mature PH20 36-482 with G at a position corresponding to amino acid residue 70
LNFRAPPVIPNVPFLWAWNAPSEFCLGKFDEPLDMSLFSFIGSPRINATGQGVTIFYVDRLGYYPYIDSGTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 213 - protein, 447 aa, Artificial Sequence
  Mature PH20 36-482 with H at a position corresponding to amino acid residue 70
LNFRAPPVIPNVPFLWAWNAPSEFCLGKFDEPLDMSLFSFIGSPRINATGQGVTIFYVDRLGYYPYIDSHTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 214 - protein, 447 aa, Artificial Sequence
  Mature PH20 36-482 with K at a position corresponding to amino acid residue 70
LNFRAPPVIPNVPFLWAWNAPSEFCLGKFDEPLDMSLFSFIGSPRINATGQGVTIFYVDRLGYYPYIDSKTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 215 - protein, 447 aa, Artificial Sequence
  Mature PH20 36-482 with L at a position corresponding to amino acid residue 70
LNFRAPPVIPNVPFLWAWNAPSEFCLGKFDEPLDMSLFSFIGSPRINATGQGVTIFYVDRLGYYPYIDSLTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 216 - protein, 447 aa, Artificial Sequence
  Mature PH20 36-482 with N at a position corresponding to amino acid residue 70
LNFRAPPVIPNVPFLWAWNAPSEFCLGKFDEPLDMSLFSFIGSPRINATGQGVTIFYVDRLGYYPYIDSNTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 217 - protein, 447 aa, Artificial Sequence
  Mature PH20 36-482 with P at a position corresponding to amino acid residue 70
LNFRAPPVIPNVPFLWAWNAPSEFCLGKFDEPLDMSLFSFIGSPRINATGQGVTIFYVDRLGYYPYIDSPTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 218 - protein, 447 aa, Artificial Sequence
  Mature PH20 36-482 with R at a position corresponding to amino acid residue 70
LNFRAPPVIPNVPFLWAWNAPSEFCLGKFDEPLDMSLFSFIGSPRINATGQGVTIFYVDRLGYYPYIDSRTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 219 - protein, 447 aa, Artificial Sequence
  Mature PH20 36-482 with S at a position corresponding to amino acid residue 70
LNFRAPPVIPNVPFLWAWNAPSEFCLGKFDEPLDMSLFSFIGSPRINATGQGVTIFYVDRLGYYPYIDSSTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 220 - protein, 447 aa, Artificial Sequence
  Mature PH20 36-482 with T at a position corresponding to amino acid residue 70
LNFRAPPVIPNVPFLWAWNAPSEFCLGKFDEPLDMSLFSFIGSPRINATGQGVTIFYVDRLGYYPYIDSTTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 221 - protein, 447 aa, Artificial Sequence
  Mature PH20 36-482 with V at a position corresponding to amino acid residue 70
LNFRAPPVIPNVPFLWAWNAPSEFCLGKFDEPLDMSLFSFIGSPRINATGQGVTIFYVDRLGYYPYIDSVTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 222 - protein, 447 aa, Artificial Sequence
  Mature PH20 36-482 with Y at a position corresponding to amino acid residue 70
LNFRAPPVIPNVPFLWAWNAPSEFCLGKFDEPLDMSLFSFIGSPRINATGQGVTIFYVDRLGYYPYIDSYTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 223 - protein, 447 aa, Artificial Sequence
  Mature PH20 36-482 with G at a position corresponding to amino acid residue 71
LNFRAPPVIPNVPFLWAWNAPSEFCLGKFDEPLDMSLFSFIGSPRINATGQGVTIFYVDRLGYYPYIDSIGGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 224 - protein, 447 aa, Artificial Sequence
  Mature PH20 36-482 with N at a position corresponding to amino acid residue 71
LNFRAPPVIPNVPFLWAWNAPSEFCLGKFDEPLDMSLFSFIGSPRINATGQGVTIFYVDRLGYYPYIDSINGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 225 - protein, 447 aa, Artificial Sequence
  Mature PH20 36-482 with R at a position corresponding to amino acid residue 71
LNFRAPPVIPNVPFLWAWNAPSEFCLGKFDEPLDMSLFSFIGSPRINATGQGVTIFYVDRLGYYPYIDSIRGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 226 - protein, 447 aa, Artificial Sequence
  Mature PH20 36-482 with S at a position corresponding to amino acid residue 71
LNFRAPPVIPNVPFLWAWNAPSEFCLGKFDEPLDMSLFSFIGSPRINATGQGVTIFYVDRLGYYPYIDSISGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 227 - protein, 447 aa, Artificial Sequence
  Mature PH20 36-482 with K at a position corresponding to amino acid residue 72
LNFRAPPVIPNVPFLWAWNAPSEFCLGKFDEPLDMSLFSFIGSPRINATGQGVTIFYVDRLGYYPYIDSITKVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 228 - protein, 447 aa, Artificial Sequence
  Mature PH20 36-482 with M at a position corresponding to amino acid residue 72
LNFRAPPVIPNVPFLWAWNAPSEFCLGKFDEPLDMSLFSFIGSPRINATGQGVTIFYVDRLGYYPYIDSITMVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 229 - protein, 447 aa, Artificial Sequence
  Mature PH20 36-482 with Q at a position corresponding to amino acid residue 72
LNFRAPPVIPNVPFLWAWNAPSEFCLGKFDEPLDMSLFSFIGSPRINATGQGVTIFYVDRLGYYPYIDSITQVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 230 - protein, 447 aa, Artificial Sequence
  Mature PH20 36-482 with A at a position corresponding to amino acid residue 73
LNFRAPPVIPNVPFLWAWNAPSEFCLGKFDEPLDMSLFSFIGSPRINATGQGVTIFYVDRLGYYPYIDSITGATVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 231 - protein, 447 aa, Artificial Sequence
  Mature PH20 36-482 with H at a position corresponding to amino acid residue 73
LNFRAPPVIPNVPFLWAWNAPSEFCLGKFDEPLDMSLFSFIGSPRINATGQGVTIFYVDRLGYYPYIDSITGHTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 232 - protein, 447 aa, Artificial Sequence
  Mature PH20 36-482 with K at a position corresponding to amino acid residue 73
LNFRAPPVIPNVPFLWAWNAPSEFCLGKFDEPLDMSLFSFIGSPRINATGQGVTIFYVDRLGYYPYIDSITGKTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 233 - protein, 447 aa, Artificial Sequence
  Mature PH20 36-482 with L at a position corresponding to amino acid residue 73
LNFRAPPVIPNVPFLWAWNAPSEFCLGKFDEPLDMSLFSFIGSPRINATGQGVTIFYVDRLGYYPYIDSITGLTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 234 - protein, 447 aa, Artificial Sequence
  Mature PH20 36-482 with Q at a position corresponding to amino acid residue 73
LNFRAPPVIPNVPFLWAWNAPSEFCLGKFDEPLDMSLFSFIGSPRINATGQGVTIFYVDRLGYYPYIDSITGQTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 235 - protein, 447 aa, Artificial Sequence
  Mature PH20 36-482 with R at a position corresponding to amino acid residue 73
LNFRAPPVIPNVPFLWAWNAPSEFCLGKFDEPLDMSLFSFIGSPRINATGQGVTIFYVDRLGYYPYIDSITGRTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 236 - protein, 447 aa, Artificial Sequence
  Mature PH20 36-482 with T at a position corresponding to amino acid residue 73
LNFRAPPVIPNVPFLWAWNAPSEFCLGKFDEPLDMSLFSFIGSPRINATGQGVTIFYVDRLGYYPYIDSITGTTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 237 - protein, 447 aa, Artificial Sequence
  Mature PH20 36-482 with W at a position corresponding to amino acid residue 73
LNFRAPPVIPNVPFLWAWNAPSEFCLGKFDEPLDMSLFSFIGSPRINATGQGVTIFYVDRLGYYPYIDSITGWTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 238 - protein, 447 aa, Artificial Sequence
  Mature PH20 36-482 with A at a position corresponding to amino acid residue 74
LNFRAPPVIPNVPFLWAWNAPSEFCLGKFDEPLDMSLFSFIGSPRINATGQGVTIFYVDRLGYYPYIDSITGVAVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 239 - protein, 447 aa, Artificial Sequence
  Mature PH20 36-482 with C at a position corresponding to amino acid residue 74
LNFRAPPVIPNVPFLWAWNAPSEFCLGKFDEPLDMSLFSFIGSPRINATGQGVTIFYVDRLGYYPYIDSITGVCVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 240 - protein, 447 aa, Artificial Sequence
  Mature PH20 36-482 with E at a position corresponding to amino acid residue 74
LNFRAPPVIPNVPFLWAWNAPSEFCLGKFDEPLDMSLFSFIGSPRINATGQGVTIFYVDRLGYYPYIDSITGVEVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 241 - protein, 447 aa, Artificial Sequence
  Mature PH20 36-482 with F at a position corresponding to amino acid residue 74
LNFRAPPVIPNVPFLWAWNAPSEFCLGKFDEPLDMSLFSFIGSPRINATGQGVTIFYVDRLGYYPYIDSITGVFVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 242 - protein, 447 aa, Artificial Sequence
  Mature PH20 36-482 with G at a position corresponding to amino acid residue 74
LNFRAPPVIPNVPFLWAWNAPSEFCLGKFDEPLDMSLFSFIGSPRINATGQGVTIFYVDRLGYYPYIDSITGVGVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 243 - protein, 447 aa, Artificial Sequence
  Mature PH20 36-482 with H at a position corresponding to amino acid residue 74
LNFRAPPVIPNVPFLWAWNAPSEFCLGKFDEPLDMSLFSFIGSPRINATGQGVTIFYVDRLGYYPYIDSITGVHVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 244 - protein, 447 aa, Artificial Sequence
  Mature PH20 36-482 with K at a position corresponding to amino acid residue 74
LNFRAPPVIPNVPFLWAWNAPSEFCLGKFDEPLDMSLFSFIGSPRINATGQGVTIFYVDRLGYYPYIDSITGVKVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 245 - protein, 447 aa, Artificial Sequence
  Mature PH20 36-482 with L at a position corresponding to amino acid residue 74
LNFRAPPVIPNVPFLWAWNAPSEFCLGKFDEPLDMSLFSFIGSPRINATGQGVTIFYVDRLGYYPYIDSITGVLVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 246 - protein, 447 aa, Artificial Sequence
  Mature PH20 36-482 with M at a position corresponding to amino acid residue 74
LNFRAPPVIPNVPFLWAWNAPSEFCLGKFDEPLDMSLFSFIGSPRINATGQGVTIFYVDRLGYYPYIDSITGVMVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 247 - protein, 447 aa, Artificial Sequence
  Mature PH20 36-482 with N at a position corresponding to amino acid residue 74
LNFRAPPVIPNVPFLWAWNAPSEFCLGKFDEPLDMSLFSFIGSPRINATGQGVTIFYVDRLGYYPYIDSITGVNVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 248 - protein, 447 aa, Artificial Sequence
  Mature PH20 36-482 with P at a position corresponding to amino acid residue 74
LNFRAPPVIPNVPFLWAWNAPSEFCLGKFDEPLDMSLFSFIGSPRINATGQGVTIFYVDRLGYYPYIDSITGVPVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 249 - protein, 447 aa, Artificial Sequence
  Mature PH20 36-482 with R at a position corresponding to amino acid residue 74
LNFRAPPVIPNVPFLWAWNAPSEFCLGKFDEPLDMSLFSFIGSPRINATGQGVTIFYVDRLGYYPYIDSITGVRVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 250 - protein, 447 aa, Artificial Sequence
  Mature PH20 36-482 with S at a position corresponding to amino acid residue 74
LNFRAPPVIPNVPFLWAWNAPSEFCLGKFDEPLDMSLFSFIGSPRINATGQGVTIFYVDRLGYYPYIDSITGVSVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 251 - protein, 447 aa, Artificial Sequence
  Mature PH20 36-482 with V at a position corresponding to amino acid residue 74
LNFRAPPVIPNVPFLWAWNAPSEFCLGKFDEPLDMSLFSFIGSPRINATGQGVTIFYVDRLGYYPYIDSITGVVVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 252 - protein, 447 aa, Artificial Sequence
  Mature PH20 36-482 with W at a position corresponding to amino acid residue 74
LNFRAPPVIPNVPFLWAWNAPSEFCLGKFDEPLDMSLFSFIGSPRINATGQGVTIFYVDRLGYYPYIDSITGVWVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 253 - protein, 447 aa, Artificial Sequence
  Mature PH20 36-482 with F at a position corresponding to amino acid residue 75
LNFRAPPVIPNVPFLWAWNAPSEFCLGKFDEPLDMSLFSFIGSPRINATGQGVTIFYVDRLGYYPYIDSITGVTFNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 254 - protein, 447 aa, Artificial Sequence
  Mature PH20 36-482 with L at a position corresponding to amino acid residue 75
LNFRAPPVIPNVPFLWAWNAPSEFCLGKFDEPLDMSLFSFIGSPRINATGQGVTIFYVDRLGYYPYIDSITGVTLNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 255 - protein, 447 aa, Artificial Sequence
  Mature PH20 36-482 with M at a position corresponding to amino acid residue 75
LNFRAPPVIPNVPFLWAWNAPSEFCLGKFDEPLDMSLFSFIGSPRINATGQGVTIFYVDRLGYYPYIDSITGVTMNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 256 - protein, 447 aa, Artificial Sequence
  Mature PH20 36-482 with R at a position corresponding to amino acid residue 75
LNFRAPPVIPNVPFLWAWNAPSEFCLGKFDEPLDMSLFSFIGSPRINATGQGVTIFYVDRLGYYPYIDSITGVTRNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 257 - protein, 447 aa, Artificial Sequence
  Mature PH20 36-482 with T at a position corresponding to amino acid residue 75
LNFRAPPVIPNVPFLWAWNAPSEFCLGKFDEPLDMSLFSFIGSPRINATGQGVTIFYVDRLGYYPYIDSITGVTTNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 258 - protein, 447 aa, Artificial Sequence
  Mature PH20 36-482 with L at a position corresponding to amino acid residue 79
LNFRAPPVIPNVPFLWAWNAPSEFCLGKFDEPLDMSLFSFIGSPRINATGQGVTIFYVDRLGYYPYIDSITGVTVNGGLPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 259 - protein, 447 aa, Artificial Sequence
  Mature PH20 36-482 with L at a position corresponding to amino acid residue 82
LNFRAPPVIPNVPFLWAWNAPSEFCLGKFDEPLDMSLFSFIGSPRINATGQGVTIFYVDRLGYYPYIDSITGVTVNGGIPQLISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 260 - protein, 447 aa, Artificial Sequence
  Mature PH20 36-482 with N at a position corresponding to amino acid residue 82
LNFRAPPVIPNVPFLWAWNAPSEFCLGKFDEPLDMSLFSFIGSPRINATGQGVTIFYVDRLGYYPYIDSITGVTVNGGIPQNISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 261 - protein, 447 aa, Artificial Sequence
  Mature PH20 36-482 with V at a position corresponding to amino acid residue 83
LNFRAPPVIPNVPFLWAWNAPSEFCLGKFDEPLDMSLFSFIGSPRINATGQGVTIFYVDRLGYYPYIDSITGVTVNGGIPQKVSLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 262 - protein, 447 aa, Artificial Sequence
  Mature PH20 36-482 with Q at a position corresponding to amino acid residue 83
LNFRAPPVIPNVPFLWAWNAPSEFCLGKFDEPLDMSLFSFIGSPRINATGQGVTIFYVDRLGYYPYIDSITGVTVNGGIPQKQSLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 263 - protein, 447 aa, Artificial Sequence
  Mature PH20 36-482 with S at a position corresponding to amino acid residue 83
LNFRAPPVIPNVPFLWAWNAPSEFCLGKFDEPLDMSLFSFIGSPRINATGQGVTIFYVDRLGYYPYIDSITGVTVNGGIPQKSSLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 264 - protein, 447 aa, Artificial Sequence
  Mature PH20 36-482 with G at a position corresponding to amino acid residue 83
LNFRAPPVIPNVPFLWAWNAPSEFCLGKFDEPLDMSLFSFIGSPRINATGQGVTIFYVDRLGYYPYIDSITGVTVNGGIPQKGSLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 265 - protein, 447 aa, Artificial Sequence
  Mature PH20 36-482 with E at a position corresponding to amino acid residue 84
LNFRAPPVIPNVPFLWAWNAPSEFCLGKFDEPLDMSLFSFIGSPRINATGQGVTIFYVDRLGYYPYIDSITGVTVNGGIPQKIELQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 266 - protein, 447 aa, Artificial Sequence
  Mature PH20 36-482 with F at a position corresponding to amino acid residue 84
LNFRAPPVIPNVPFLWAWNAPSEFCLGKFDEPLDMSLFSFIGSPRINATGQGVTIFYVDRLGYYPYIDSITGVTVNGGIPQKIFLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 267 - protein, 447 aa, Artificial Sequence
  Mature PH20 36-482 with G at a position corresponding to amino acid residue 84
LNFRAPPVIPNVPFLWAWNAPSEFCLGKFDEPLDMSLFSFIGSPRINATGQGVTIFYVDRLGYYPYIDSITGVTVNGGIPQKIGLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 268 - protein, 447 aa, Artificial Sequence
  Mature PH20 36-482 with N at a position corresponding to amino acid residue 84
LNFRAPPVIPNVPFLWAWNAPSEFCLGKFDEPLDMSLFSFIGSPRINATGQGVTIFYVDRLGYYPYIDSITGVTVNGGIPQKINLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 269 - protein, 447 aa, Artificial Sequence
  Mature PH20 36-482 with R at a position corresponding to amino acid residue 84
LNFRAPPVIPNVPFLWAWNAPSEFCLGKFDEPLDMSLFSFIGSPRINATGQGVTIFYVDRLGYYPYIDSITGVTVNGGIPQKIRLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 270 - protein, 447 aa, Artificial Sequence
  Mature PH20 36-482 with A at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLADHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 271 - protein, 447 aa, Artificial Sequence
  Mature PH20 36-482 with H at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLHDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 272 - protein, 447 aa, Artificial Sequence
  Mature PH20 36-482 with K at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLKDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 273 - protein, 447 aa, Artificial Sequence
  Mature PH20 36-482 with N at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLNDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 274 - protein, 447 aa, Artificial Sequence
  Mature PH20 36-482 with S at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLSDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 275 - protein, 447 aa, Artificial Sequence
  Mature PH20 36-482 with T at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLTDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 276 - protein, 447 aa, Artificial Sequence
  Mature PH20 36-482 with W at a position corresponding to amino acid residue 86
LNFRAPPVIPNVPFLWAWNAPSEFCLGKFDEPLDMSLFSFIGSPRINATGQGVTIFYVDRLGYYPYIDSITGVTVNGGIPQKISLWDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 277 - protein, 447 aa, Artificial Sequence
  Mature PH20 36-482 with C at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQCHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 278 - protein, 447 aa, Artificial Sequence
  Mature PH20 36-482 with G at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQGHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 279 - protein, 447 aa, Artificial Sequence
  Mature PH20 36-482 with L at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQLHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 280 - protein, 447 aa, Artificial Sequence
  Mature PH20 36-482 with M at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQMHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 281 - protein, 447 aa, Artificial Sequence
  Mature PH20 36-482 with R at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQRHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 282 - protein, 447 aa, Artificial Sequence
  Mature PH20 36-482 with S at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQSHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 283 - protein, 447 aa, Artificial Sequence
  Mature PH20 36-482 with T at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQTHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 284 - protein, 447 aa, Artificial Sequence
  Mature PH20 36-482 with V at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQVHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 285 - protein, 447 aa, Artificial Sequence
  Mature PH20 36-482 with Y at a position corresponding to amino acid residue 87
LNFRAPPVIPNVPFLWAWNAPSEFCLGKFDEPLDMSLFSFIGSPRINATGQGVTIFYVDRLGYYPYIDSITGVTVNGGIPQKISLQYHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 286 - protein, 447 aa, Artificial Sequence
  Mature PH20 36-482 with C at a position corresponding to amino acid residue 89
LNFRAPPVIPNVPFLWAWNAPSEFCLGKFDEPLDMSLFSFIGSPRINATGQGVTIFYVDRLGYYPYIDSITGVTVNGGIPQKISLQDHCDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 287 - protein, 447 aa, Artificial Sequence
  Mature PH20 36-482 with A at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLAKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 288 - protein, 447 aa, Artificial Sequence
  Mature PH20 36-482 with E at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLEKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 289 - protein, 447 aa, Artificial Sequence
  Mature PH20 36-482 with H at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLHKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 290 - protein, 447 aa, Artificial Sequence
  Mature PH20 36-482 with K at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLKKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 291 - protein, 447 aa, Artificial Sequence
  Mature PH20 36-482 with N at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLNKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 292 - protein, 447 aa, Artificial Sequence
  Mature PH20 36-482 with R at a position corresponding to amino acid residue 90
LNFRAPPVIPNVPFLWAWNAPSEFCLGKFDEPLDMSLFSFIGSPRINATGQGVTIFYVDRLGYYPYIDSITGVTVNGGIPQKISLQDHLRKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 293 - protein, 447 aa, Artificial Sequence
  Mature PH20 36-482 with C at a position corresponding to amino acid residue 92
LNFRAPPVIPNVPFLWAWNAPSEFCLGKFDEPLDMSLFSFIGSPRINATGQGVTIFYVDRLGYYPYIDSITGVTVNGGIPQKISLQDHLDKCKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 294 - protein, 447 aa, Artificial Sequence
  Mature PH20 36-482 with L at a position corresponding to amino acid residue 92
LNFRAPPVIPNVPFLWAWNAPSEFCLGKFDEPLDMSLFSFIGSPRINATGQGVTIFYVDRLGYYPYIDSITGVTVNGGIPQKISLQDHLDKLKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 295 - protein, 447 aa, Artificial Sequence
  Mature PH20 36-482 with I at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKAIKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 296 - protein, 447 aa, Artificial Sequence
  Mature PH20 36-482 with L at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKALKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 297 - protein, 447 aa, Artificial Sequence
  Mature PH20 36-482 with Q at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKAQKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 298 - protein, 447 aa, Artificial Sequence
  Mature PH20 36-482 with R at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKARKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 299 - protein, 447 aa, Artificial Sequence
  Mature PH20 36-482 with S at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKASKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 300 - protein, 447 aa, Artificial Sequence
  Mature PH20 36-482 with T at a position corresponding to amino acid residue 93
LNFRAPPVIPNVPFLWAWNAPSEFCLGKFDEPLDMSLFSFIGSPRINATGQGVTIFYVDRLGYYPYIDSITGVTVNGGIPQKISLQDHLDKATKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 301 - protein, 447 aa, Artificial Sequence
  Mature PH20 36-482 with D at a position corresponding to amino acid residue 94
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKDDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 302 - protein, 447 aa, Artificial Sequence
  Mature PH20 36-482 with Q at a position corresponding to amino acid residue 94
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKQDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 303 - protein, 447 aa, Artificial Sequence
  Mature PH20 36-482 with R at a position corresponding to amino acid residue 94
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKRDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 304 - protein, 447 aa, Artificial Sequence
  Mature PH20 36-482 with A at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDIAFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 305 - protein, 447 aa, Artificial Sequence
  Mature PH20 36-482 with C at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDICFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 306 - protein, 447 aa, Artificial Sequence
  Mature PH20 36-482 with D at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDIDFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 307 - protein, 447 aa, Artificial Sequence
  Mature PH20 36-482 with E at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDIEFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 308 - protein, 447 aa, Artificial Sequence
  Mature PH20 36-482 with G at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDIGFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 309 - protein, 447 aa, Artificial Sequence
  Mature PH20 36-482 with L at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDILFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 310 - protein, 447 aa, Artificial Sequence
  Mature PH20 36-482 with S at a position corresponding to amino acid residue 97
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDISFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 311 - protein, 447 aa, Artificial Sequence
  Mature PH20 36-482 with S at a position corresponding to amino acid residue 102
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPSDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 312 - protein, 447 aa, Artificial Sequence
  Mature PH20 36-482 with T at a position corresponding to amino acid residue 102
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPTDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 313 - protein, 447 aa, Artificial Sequence
  Mature PH20 36-482 with R at a position corresponding to amino acid residue 104
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDRLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 314 - protein, 447 aa, Artificial Sequence
  Mature PH20 36-482 with L at a position corresponding to amino acid residue 107
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGLAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 315 - protein, 447 aa, Artificial Sequence
  Mature PH20 36-482 with A at a position corresponding to amino acid residue 114
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEAWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 316 - protein, 447 aa, Artificial Sequence
  Mature PH20 36-482 with Q at a position corresponding to amino acid residue 118
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPQWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 317 - protein, 447 aa, Artificial Sequence
  Mature PH20 36-482 with H at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWHRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 318 - protein, 447 aa, Artificial Sequence
  Mature PH20 36-482 with F at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWFRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 319 - protein, 447 aa, Artificial Sequence
  Mature PH20 36-482 with I at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWIRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 320 - protein, 447 aa, Artificial Sequence
  Mature PH20 36-482 with S at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWSRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 321 - protein, 447 aa, Artificial Sequence
  Mature PH20 36-482 with V at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWVRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 322 - protein, 447 aa, Artificial Sequence
  Mature PH20 36-482 with Y at a position corresponding to amino acid residue 120
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWYRNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 323 - protein, 447 aa, Artificial Sequence
  Mature PH20 36-482 with E at a position corresponding to amino acid residue 127
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKEVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 324 - protein, 447 aa, Artificial Sequence
  Mature PH20 36-482 with H at a position corresponding to amino acid residue 127
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKHVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 325 - protein, 447 aa, Artificial Sequence
  Mature PH20 36-482 with N at a position corresponding to amino acid residue 127
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKNVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 326 - protein, 447 aa, Artificial Sequence
  Mature PH20 36-482 with Q at a position corresponding to amino acid residue 127
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKQVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 327 - protein, 447 aa, Artificial Sequence
  Mature PH20 36-482 with R at a position corresponding to amino acid residue 127
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKRVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 328 - protein, 447 aa, Artificial Sequence
  Mature PH20 36-482 with I at a position corresponding to amino acid residue 128
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDIYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 329 - protein, 447 aa, Artificial Sequence
  Mature PH20 36-482 with R at a position corresponding to amino acid residue 130
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYRNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 330 - protein, 447 aa, Artificial Sequence
  Mature PH20 36-482 with G at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKGRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 331 - protein, 447 aa, Artificial Sequence
  Mature PH20 36-482 with I at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKIRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 332 - protein, 447 aa, Artificial Sequence
  Mature PH20 36-482 with M at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKMRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 333 - protein, 447 aa, Artificial Sequence
  Mature PH20 36-482 with Q at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKQRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 334 - protein, 447 aa, Artificial Sequence
  Mature PH20 36-482 with R at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKRRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 335 - protein, 447 aa, Artificial Sequence
  Mature PH20 36-482 with V at a position corresponding to amino acid residue 131
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKVRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 336 - protein, 447 aa, Artificial Sequence
  Mature PH20 36-482 with N at a position corresponding to amino acid residue 132
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNNSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 337 - protein, 447 aa, Artificial Sequence
  Mature PH20 36-482 with L at a position corresponding to amino acid residue 132
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNLSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 338 - protein, 447 aa, Artificial Sequence
  Mature PH20 36-482 with D at a position corresponding to amino acid residue 135
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIDLVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 339 - protein, 447 aa, Artificial Sequence
  Mature PH20 36-482 with G at a position corresponding to amino acid residue 135
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIGLVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 340 - protein, 447 aa, Artificial Sequence
  Mature PH20 36-482 with R at a position corresponding to amino acid residue 135
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIRLVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 341 - protein, 447 aa, Artificial Sequence
  Mature PH20 36-482 with L at a position corresponding to amino acid residue 138
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVLQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 342 - protein, 447 aa, Artificial Sequence
  Mature PH20 36-482 with T at a position corresponding to amino acid residue 139
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQTQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 343 - protein, 447 aa, Artificial Sequence
  Mature PH20 36-482 with K at a position corresponding to amino acid residue 140
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQKNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 344 - protein, 447 aa, Artificial Sequence
  Mature PH20 36-482 with H at a position corresponding to amino acid residue 141
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQHVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 345 - protein, 447 aa, Artificial Sequence
  Mature PH20 36-482 with R at a position corresponding to amino acid residue 141
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQRVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 346 - protein, 447 aa, Artificial Sequence
  Mature PH20 36-482 with S at a position corresponding to amino acid residue 141
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQSVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 347 - protein, 447 aa, Artificial Sequence
  Mature PH20 36-482 with W at a position corresponding to amino acid residue 141
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQWVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 348 - protein, 447 aa, Artificial Sequence
  Mature PH20 36-482 with Y at a position corresponding to amino acid residue 141
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQYVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 349 - protein, 447 aa, Artificial Sequence
  Mature PH20 36-482 with D at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNDQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 350 - protein, 447 aa, Artificial Sequence
  Mature PH20 36-482 with G at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNGQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 351 - protein, 447 aa, Artificial Sequence
  Mature PH20 36-482 with K at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNKQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 352 - protein, 447 aa, Artificial Sequence
  Mature PH20 36-482 with N at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNNQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 353 - protein, 447 aa, Artificial Sequence
  Mature PH20 36-482 with P at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNPQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 354 - protein, 447 aa, Artificial Sequence
  Mature PH20 36-482 with Q at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNQQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 355 - protein, 447 aa, Artificial Sequence
  Mature PH20 36-482 with R at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNRQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 356 - protein, 447 aa, Artificial Sequence
  Mature PH20 36-482 with S at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNSQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 357 - protein, 447 aa, Artificial Sequence
  Mature PH20 36-482 with T at a position corresponding to amino acid residue 142
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNTQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 358 - protein, 447 aa, Artificial Sequence
  Mature PH20 36-482 with G at a position corresponding to amino acid residue 143
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVGLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 359 - protein, 447 aa, Artificial Sequence
  Mature PH20 36-482 with K at a position corresponding to amino acid residue 143
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVKLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 360 - protein, 447 aa, Artificial Sequence
  Mature PH20 36-482 with R at a position corresponding to amino acid residue 144
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQRSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 361 - protein, 447 aa, Artificial Sequence
  Mature PH20 36-482 with T at a position corresponding to amino acid residue 144
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQTSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 362 - protein, 447 aa, Artificial Sequence
  Mature PH20 36-482 with P at a position corresponding to amino acid residue 146
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSPTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 363 - protein, 447 aa, Artificial Sequence
  Mature PH20 36-482 with R at a position corresponding to amino acid residue 146
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSRTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 364 - protein, 447 aa, Artificial Sequence
  Mature PH20 36-482 with A at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLAEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 365 - protein, 447 aa, Artificial Sequence
  Mature PH20 36-482 with F at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLFEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 366 - protein, 447 aa, Artificial Sequence
  Mature PH20 36-482 with L at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLLEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 367 - protein, 447 aa, Artificial Sequence
  Mature PH20 36-482 with R at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLREATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 368 - protein, 447 aa, Artificial Sequence
  Mature PH20 36-482 with S at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLSEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 369 - protein, 447 aa, Artificial Sequence
  Mature PH20 36-482 with V at a position corresponding to amino acid residue 147
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLVEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 370 - protein, 447 aa, Artificial Sequence
  Mature PH20 36-482 with H at a position corresponding to amino acid residue 148
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTHATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 371 - protein, 447 aa, Artificial Sequence
  Mature PH20 36-482 with K at a position corresponding to amino acid residue 148
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTKATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 372 - protein, 447 aa, Artificial Sequence
  Mature PH20 36-482 with Q at a position corresponding to amino acid residue 148
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTQATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 373 - protein, 447 aa, Artificial Sequence
  Mature PH20 36-482 with T at a position corresponding to amino acid residue 149
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTETTEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 374 - protein, 447 aa, Artificial Sequence
  Mature PH20 36-482 with V at a position corresponding to amino acid residue 149
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEVTEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 375 - protein, 447 aa, Artificial Sequence
  Mature PH20 36-482 with A at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEAAEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 376 - protein, 447 aa, Artificial Sequence
  Mature PH20 36-482 with D at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEADEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 377 - protein, 447 aa, Artificial Sequence
  Mature PH20 36-482 with G at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEAGEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 378 - protein, 447 aa, Artificial Sequence
  Mature PH20 36-482 with N at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEANEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 379 - protein, 447 aa, Artificial Sequence
  Mature PH20 36-482 with S at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEASEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 380 - protein, 447 aa, Artificial Sequence
  Mature PH20 36-482 with W at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEAWEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 381 - protein, 447 aa, Artificial Sequence
  Mature PH20 36-482 with Y at a position corresponding to amino acid residue 150
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEAYEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 382 - protein, 447 aa, Artificial Sequence
  Mature PH20 36-482 with A at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATAKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 383 - protein, 447 aa, Artificial Sequence
  Mature PH20 36-482 with H at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATHKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 384 - protein, 447 aa, Artificial Sequence
  Mature PH20 36-482 with K at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATKKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 385 - protein, 447 aa, Artificial Sequence
  Mature PH20 36-482 with L at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATLKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 386 - protein, 447 aa, Artificial Sequence
  Mature PH20 36-482 with M at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATMKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 387 - protein, 447 aa, Artificial Sequence
  Mature PH20 36-482 with Q at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATQKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 388 - protein, 447 aa, Artificial Sequence
  Mature PH20 36-482 with R at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATRKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 389 - protein, 447 aa, Artificial Sequence
  Mature PH20 36-482 with S at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATSKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 390 - protein, 447 aa, Artificial Sequence
  Mature PH20 36-482 with T at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATTKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 391 - protein, 447 aa, Artificial Sequence
  Mature PH20 36-482 with V at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATVKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 392 - protein, 447 aa, Artificial Sequence
  Mature PH20 36-482 with W at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATWKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 393 - protein, 447 aa, Artificial Sequence
  Mature PH20 36-482 with Y at a position corresponding to amino acid residue 151
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATYKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 394 - protein, 447 aa, Artificial Sequence
  Mature PH20 36-482 with R at a position corresponding to amino acid residue 152
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATERAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 395 - protein, 447 aa, Artificial Sequence
  Mature PH20 36-482 with T at a position corresponding to amino acid residue 152
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATETAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 396 - protein, 447 aa, Artificial Sequence
  Mature PH20 36-482 with W at a position corresponding to amino acid residue 152
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEWAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 397 - protein, 447 aa, Artificial Sequence
  Mature PH20 36-482 with D at a position corresponding to amino acid residue 155
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKDEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 398 - protein, 447 aa, Artificial Sequence
  Mature PH20 36-482 with G at a position corresponding to amino acid residue 155
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKGEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 399 - protein, 447 aa, Artificial Sequence
  Mature PH20 36-482 with K at a position corresponding to amino acid residue 155
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKKEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 400 - protein, 447 aa, Artificial Sequence
  Mature PH20 36-482 with R at a position corresponding to amino acid residue 155
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKREFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 401 - protein, 447 aa, Artificial Sequence
  Mature PH20 36-482 with D at a position corresponding to amino acid residue 156
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQDFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 402 - protein, 447 aa, Artificial Sequence
  Mature PH20 36-482 with Q at a position corresponding to amino acid residue 158
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFQKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 403 - protein, 447 aa, Artificial Sequence
  Mature PH20 36-482 with S at a position corresponding to amino acid residue 158
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFSKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 404 - protein, 447 aa, Artificial Sequence
  Mature PH20 36-482 with S at a position corresponding to amino acid residue 160
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKSGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 405 - protein, 447 aa, Artificial Sequence
  Mature PH20 36-482 with E at a position corresponding to amino acid residue 162
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGEDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 406 - protein, 447 aa, Artificial Sequence
  Mature PH20 36-482 with A at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKAFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 407 - protein, 447 aa, Artificial Sequence
  Mature PH20 36-482 with E at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKEFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 408 - protein, 447 aa, Artificial Sequence
  Mature PH20 36-482 with K at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKKFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 409 - protein, 447 aa, Artificial Sequence
  Mature PH20 36-482 with Q at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKQFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 410 - protein, 447 aa, Artificial Sequence
  Mature PH20 36-482 with R at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKRFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 411 - protein, 447 aa, Artificial Sequence
  Mature PH20 36-482 with S at a position corresponding to amino acid residue 163
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKSFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 412 - protein, 447 aa, Artificial Sequence
  Mature PH20 36-482 with M at a position corresponding to amino acid residue 164
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDMLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 413 - protein, 447 aa, Artificial Sequence
  Mature PH20 36-482 with V at a position corresponding to amino acid residue 164
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDVLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 414 - protein, 447 aa, Artificial Sequence
  Mature PH20 36-482 with D at a position corresponding to amino acid residue 165
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFDVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 415 - protein, 447 aa, Artificial Sequence
  Mature PH20 36-482 with F at a position corresponding to amino acid residue 165
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFFVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 416 - protein, 447 aa, Artificial Sequence
  Mature PH20 36-482 with N at a position corresponding to amino acid residue 165
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFNVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 417 - protein, 447 aa, Artificial Sequence
  Mature PH20 36-482 with S at a position corresponding to amino acid residue 165
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFSVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 418 - protein, 447 aa, Artificial Sequence
  Mature PH20 36-482 with V at a position corresponding to amino acid residue 165
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFVVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 419 - protein, 447 aa, Artificial Sequence
  Mature PH20 36-482 with A at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLAETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 420 - protein, 447 aa, Artificial Sequence
  Mature PH20 36-482 with E at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLEETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 421 - protein, 447 aa, Artificial Sequence
  Mature PH20 36-482 with F at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLFETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 422 - protein, 447 aa, Artificial Sequence
  Mature PH20 36-482 with H at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLHETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 423 - protein, 447 aa, Artificial Sequence
  Mature PH20 36-482 with L at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLLETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 424 - protein, 447 aa, Artificial Sequence
  Mature PH20 36-482 with Q at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLQETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 425 - protein, 447 aa, Artificial Sequence
  Mature PH20 36-482 with R at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLRETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 426 - protein, 447 aa, Artificial Sequence
  Mature PH20 36-482 with T at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLTETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 427 - protein, 447 aa, Artificial Sequence
  Mature PH20 36-482 with W at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLWETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 428 - protein, 447 aa, Artificial Sequence
  Mature PH20 36-482 with Y at a position corresponding to amino acid residue 166
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLYETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 429 - protein, 447 aa, Artificial Sequence
  Mature PH20 36-482 with D at a position corresponding to amino acid residue 167
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVDTIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 430 - protein, 447 aa, Artificial Sequence
  Mature PH20 36-482 with L at a position corresponding to amino acid residue 169
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETLKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 431 - protein, 447 aa, Artificial Sequence
  Mature PH20 36-482 with R at a position corresponding to amino acid residue 170
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIRLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 432 - protein, 447 aa, Artificial Sequence
  Mature PH20 36-482 with A at a position corresponding to amino acid residue 172
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLAKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 433 - protein, 447 aa, Artificial Sequence
  Mature PH20 36-482 with R at a position corresponding to amino acid residue 173
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGRLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 434 - protein, 447 aa, Artificial Sequence
  Mature PH20 36-482 with G at a position corresponding to amino acid residue 174
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKGLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 435 - protein, 447 aa, Artificial Sequence
  Mature PH20 36-482 with K at a position corresponding to amino acid residue 174
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKKLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 436 - protein, 447 aa, Artificial Sequence
  Mature PH20 36-482 with N at a position corresponding to amino acid residue 174
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKNLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 437 - protein, 447 aa, Artificial Sequence
  Mature PH20 36-482 with R at a position corresponding to amino acid residue 174
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKRLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 438 - protein, 447 aa, Artificial Sequence
  Mature PH20 36-482 with T at a position corresponding to amino acid residue 174
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKTLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 439 - protein, 447 aa, Artificial Sequence
  Mature PH20 36-482 with T at a position corresponding to amino acid residue 175
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLTRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 440 - protein, 447 aa, Artificial Sequence
  Mature PH20 36-482 with K at a position corresponding to amino acid residue 178
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPKHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 441 - protein, 447 aa, Artificial Sequence
  Mature PH20 36-482 with R at a position corresponding to amino acid residue 178
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPRHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 442 - protein, 447 aa, Artificial Sequence
  Mature PH20 36-482 with K at a position corresponding to amino acid residue 179
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNKLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 443 - protein, 447 aa, Artificial Sequence
  Mature PH20 36-482 with Q at a position corresponding to amino acid residue 193
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHQYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 444 - protein, 447 aa, Artificial Sequence
  Mature PH20 36-482 with T at a position corresponding to amino acid residue 195
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYTKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 445 - protein, 447 aa, Artificial Sequence
  Mature PH20 36-482 with N at a position corresponding to amino acid residue 195
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYNKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 446 - protein, 447 aa, Artificial Sequence
  Mature PH20 36-482 with E at a position corresponding to amino acid residue 196
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKEPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 447 - protein, 447 aa, Artificial Sequence
  Mature PH20 36-482 with R at a position corresponding to amino acid residue 196
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKRPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 448 - protein, 447 aa, Artificial Sequence
  Mature PH20 36-482 with D at a position corresponding to amino acid residue 198
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPDYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 449 - protein, 447 aa, Artificial Sequence
  Mature PH20 36-482 with P at a position corresponding to amino acid residue 204
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCPNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 450 - protein, 447 aa, Artificial Sequence
  Mature PH20 36-482 with A at a position corresponding to amino acid residue 205
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFAVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 451 - protein, 447 aa, Artificial Sequence
  Mature PH20 36-482 with E at a position corresponding to amino acid residue 205
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFEVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 452 - protein, 447 aa, Artificial Sequence
  Mature PH20 36-482 with L at a position corresponding to amino acid residue 205
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFLVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 453 - protein, 447 aa, Artificial Sequence
  Mature PH20 36-482 with T at a position corresponding to amino acid residue 205
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFTVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 454 - protein, 447 aa, Artificial Sequence
  Mature PH20 36-482 with I at a position corresponding to amino acid residue 206
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNIEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 455 - protein, 447 aa, Artificial Sequence
  Mature PH20 36-482 with K at a position corresponding to amino acid residue 206
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNKEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 456 - protein, 447 aa, Artificial Sequence
  Mature PH20 36-482 with L at a position corresponding to amino acid residue 206
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNLEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 457 - protein, 447 aa, Artificial Sequence
  Mature PH20 36-482 with R at a position corresponding to amino acid residue 206
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNREIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 458 - protein, 447 aa, Artificial Sequence
  Mature PH20 36-482 with R at a position corresponding to amino acid residue 209
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIRRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 459 - protein, 447 aa, Artificial Sequence
  Mature PH20 36-482 with N at a position corresponding to amino acid residue 212
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNNDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 460 - protein, 447 aa, Artificial Sequence
  Mature PH20 36-482 with S at a position corresponding to amino acid residue 212
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNSDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 461 - protein, 447 aa, Artificial Sequence
  Mature PH20 36-482 with A at a position corresponding to amino acid residue 213
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDALSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 462 - protein, 447 aa, Artificial Sequence
  Mature PH20 36-482 with M at a position corresponding to amino acid residue 213
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDMLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 463 - protein, 447 aa, Artificial Sequence
  Mature PH20 36-482 with N at a position corresponding to amino acid residue 213
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDNLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 464 - protein, 447 aa, Artificial Sequence
  Mature PH20 36-482 with H at a position corresponding to amino acid residue 215
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLHWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 465 - protein, 447 aa, Artificial Sequence
  Mature PH20 36-482 with M at a position corresponding to amino acid residue 215
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLMWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 466 - protein, 447 aa, Artificial Sequence
  Mature PH20 36-482 with A at a position corresponding to amino acid residue 219
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWAESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 467 - protein, 447 aa, Artificial Sequence
  Mature PH20 36-482 with I at a position corresponding to amino acid residue 219
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWIESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 468 - protein, 447 aa, Artificial Sequence
  Mature PH20 36-482 with K at a position corresponding to amino acid residue 219
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWKESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 469 - protein, 447 aa, Artificial Sequence
  Mature PH20 36-482 with S at a position corresponding to amino acid residue 219
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWSESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 470 - protein, 447 aa, Artificial Sequence
  Mature PH20 36-482 with H at a position corresponding to amino acid residue 220
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNHSTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 471 - protein, 447 aa, Artificial Sequence
  Mature PH20 36-482 with I at a position corresponding to amino acid residue 220
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNISTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 472 - protein, 447 aa, Artificial Sequence
  Mature PH20 36-482 with L at a position corresponding to amino acid residue 220
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNLSTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 473 - protein, 447 aa, Artificial Sequence
  Mature PH20 36-482 with V at a position corresponding to amino acid residue 220
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNVSTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 474 - protein, 447 aa, Artificial Sequence
  Mature PH20 36-482 with Q at a position corresponding to amino acid residue 221
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNEQTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 475 - protein, 447 aa, Artificial Sequence
  Mature PH20 36-482 with G at a position corresponding to amino acid residue 222
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESGALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 476 - protein, 447 aa, Artificial Sequence
  Mature PH20 36-482 with F at a position corresponding to amino acid residue 232
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNFQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 477 - protein, 447 aa, Artificial Sequence
  Mature PH20 36-482 with G at a position corresponding to amino acid residue 233
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTGQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 478 - protein, 447 aa, Artificial Sequence
  Mature PH20 36-482 with K at a position corresponding to amino acid residue 233
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTKQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 479 - protein, 447 aa, Artificial Sequence
  Mature PH20 36-482 with R at a position corresponding to amino acid residue 233
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTRQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 480 - protein, 447 aa, Artificial Sequence
  Mature PH20 36-482 with M at a position corresponding to amino acid residue 234
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQMSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 481 - protein, 447 aa, Artificial Sequence
  Mature PH20 36-482 with A at a position corresponding to amino acid residue 235
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQAPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 482 - protein, 447 aa, Artificial Sequence
  Mature PH20 36-482 with R at a position corresponding to amino acid residue 236
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSRVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 483 - protein, 447 aa, Artificial Sequence
  Mature PH20 36-482 with C at a position corresponding to amino acid residue 237
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPCAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 484 - protein, 447 aa, Artificial Sequence
  Mature PH20 36-482 with E at a position corresponding to amino acid residue 237
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPEAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 485 - protein, 447 aa, Artificial Sequence
  Mature PH20 36-482 with H at a position corresponding to amino acid residue 237
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPHAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 486 - protein, 447 aa, Artificial Sequence
  Mature PH20 36-482 with Q at a position corresponding to amino acid residue 237
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPQAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 487 - protein, 447 aa, Artificial Sequence
  Mature PH20 36-482 with T at a position corresponding to amino acid residue 237
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPTAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 488 - protein, 447 aa, Artificial Sequence
  Mature PH20 36-482 with E at a position corresponding to amino acid residue 238
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVEATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 489 - protein, 447 aa, Artificial Sequence
  Mature PH20 36-482 with H at a position corresponding to amino acid position 238
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVHATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 490 - protein, 447 aa, Artificial Sequence
  Mature PH20 36-482 with S at a position corresponding to amino acid residue 238
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVSATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 491 - protein, 447 aa, Artificial Sequence
  Mature PH20 36-482 with A at a position corresponding to amino acid residue 240
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAAALYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 492 - protein, 447 aa, Artificial Sequence
  Mature PH20 36-482 with Q at a position corresponding to amino acid residue 240
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAAQLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 493 - protein, 447 aa, Artificial Sequence
  Mature PH20 36-482 with I at a position corresponding to amino acid residue 247
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRIREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 494 - protein, 447 aa, Artificial Sequence
  Mature PH20 36-482 with A at a position corresponding to amino acid residue 248
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVAEAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 495 - protein, 447 aa, Artificial Sequence
  Mature PH20 36-482 with V at a position corresponding to amino acid residue 249
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVRVAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 496 - protein, 447 aa, Artificial Sequence
  Mature PH20 36-482 with G at a position corresponding to amino acid residue 257
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIGDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 497 - protein, 447 aa, Artificial Sequence
  Mature PH20 36-482 with T at a position corresponding to amino acid residue 257
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKITDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 498 - protein, 447 aa, Artificial Sequence
  Mature PH20 36-482 with R at a position corresponding to amino acid residue 257
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIRDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 499 - protein, 447 aa, Artificial Sequence
  Mature PH20 36-482 with N at a position corresponding to amino acid residue 258
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPNAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 500 - protein, 447 aa, Artificial Sequence
  Mature PH20 36-482 with S at a position corresponding to amino acid residue 258
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPSAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 501 - protein, 447 aa, Artificial Sequence
  Mature PH20 36-482 with P at a position corresponding to amino acid residue 259
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDPKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 502 - protein, 447 aa, Artificial Sequence
  Mature PH20 36-482 with M at a position corresponding to amino acid residue 260
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAMSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 503 - protein, 447 aa, Artificial Sequence
  Mature PH20 36-482 with Y at a position corresponding to amino acid residue 260
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAYSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 504 - protein, 447 aa, Artificial Sequence
  Mature PH20 36-482 with A at a position corresponding to amino acid residue 261
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKAPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 505 - protein, 447 aa, Artificial Sequence
  Mature PH20 36-482 with K at a position corresponding to amino acid residue 261
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKKPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 506 - protein, 447 aa, Artificial Sequence
  Mature PH20 36-482 with N at a position corresponding to amino acid residue 261
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKNPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 507 - protein, 447 aa, Artificial Sequence
  Mature PH20 36-482 with K at a position corresponding to amino acid residue 263
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPKPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 508 - protein, 447 aa, Artificial Sequence
  Mature PH20 36-482 with R at a position corresponding to amino acid residue 263
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPRPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 509 - protein, 447 aa, Artificial Sequence
  Mature PH20 36-482 with T at a position corresponding to amino acid residue 267
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFTYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 510 - protein, 447 aa, Artificial Sequence
  Mature PH20 36-482 with A at a position corresponding to amino acid residue 269
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYARIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 511 - protein, 447 aa, Artificial Sequence
  Mature PH20 36-482 with L at a position corresponding to amino acid residue 271
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRLVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 512 - protein, 447 aa, Artificial Sequence
  Mature PH20 36-482 with M at a position corresponding to amino acid residue 271
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRMVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 513 - protein, 447 aa, Artificial Sequence
  Mature PH20 36-482 with D at a position corresponding to amino acid residue 272
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIDFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 514 - protein, 447 aa, Artificial Sequence
  Mature PH20 36-482 with T at a position corresponding to amino acid residue 272
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRITFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 515 - protein, 447 aa, Artificial Sequence
  Mature PH20 36-482 with H at a position corresponding to amino acid residue 273
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVHTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 516 - protein, 447 aa, Artificial Sequence
  Mature PH20 36-482 with Y at a position corresponding to amino acid residue 273
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVYTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 517 - protein, 447 aa, Artificial Sequence
  Mature PH20 36-482 with F at a position corresponding to amino acid residue 274
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFFDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 518 - protein, 447 aa, Artificial Sequence
  Mature PH20 36-482 with D at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDDVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 519 - protein, 447 aa, Artificial Sequence
  Mature PH20 36-482 with H at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDHVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 520 - protein, 447 aa, Artificial Sequence
  Mature PH20 36-482 with M at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDMVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 521 - protein, 447 aa, Artificial Sequence
  Mature PH20 36-482 with R at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDRVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 522 - protein, 447 aa, Artificial Sequence
  Mature PH20 36-482 with S at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDSVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 523 - protein, 447 aa, Artificial Sequence
  Mature PH20 36-482 with Y at a position corresponding to amino acid residue 276
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDYVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 524 - protein, 447 aa, Artificial Sequence
  Mature PH20 36-482 with A at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQALKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 525 - protein, 447 aa, Artificial Sequence
  Mature PH20 36-482 with E at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQELKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 526 - protein, 447 aa, Artificial Sequence
  Mature PH20 36-482 with H at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQHLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 527 - protein, 447 aa, Artificial Sequence
  Mature PH20 36-482 with K at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQKLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 528 - protein, 447 aa, Artificial Sequence
  Mature PH20 36-482 with M at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQMLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 529 - protein, 447 aa, Artificial Sequence
  Mature PH20 36-482 with N at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQNLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 530 - protein, 447 aa, Artificial Sequence
  Mature PH20 36-482 with Q at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQQLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 531 - protein, 447 aa, Artificial Sequence
  Mature PH20 36-482 with R at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQRLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 532 - protein, 447 aa, Artificial Sequence
  Mature PH20 36-482 with S at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQSLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 533 - protein, 447 aa, Artificial Sequence
  Mature PH20 36-482 with T at a position corresponding to amino acid residue 277
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQTLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 534 - protein, 447 aa, Artificial Sequence
  Mature PH20 36-482 with E at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVEKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 535 - protein, 447 aa, Artificial Sequence
  Mature PH20 36-482 with F at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVFKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 536 - protein, 447 aa, Artificial Sequence
  Mature PH20 36-482 with G at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVGKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 537 - protein, 447 aa, Artificial Sequence
  Mature PH20 36-482 with H at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVHKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 538 - protein, 447 aa, Artificial Sequence
  Mature PH20 36-482 with K at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVKKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 539 - protein, 447 aa, Artificial Sequence
  Mature PH20 36-482 with N at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVNKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 540 - protein, 447 aa, Artificial Sequence
  Mature PH20 36-482 with R at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVRKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 541 - protein, 447 aa, Artificial Sequence
  Mature PH20 36-482 with S at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVSKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 542 - protein, 447 aa, Artificial Sequence
  Mature PH20 36-482 with T at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVTKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 543 - protein, 447 aa, Artificial Sequence
  Mature PH20 36-482 with Y at a position corresponding to amino acid residue 278
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVYKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 544 - protein, 447 aa, Artificial Sequence
  Mature PH20 36-482 with H at a position corresponding to amino acid residue 279
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLHFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 545 - protein, 447 aa, Artificial Sequence
  Mature PH20 36-482 with M at a position corresponding to amino acid residue 282
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLMQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 546 - protein, 447 aa, Artificial Sequence
  Mature PH20 36-482 with S at a position corresponding to amino acid residue 283
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSSDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 547 - protein, 447 aa, Artificial Sequence
  Mature PH20 36-482 with H at a position corresponding to amino acid residue 285
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDHLVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 548 - protein, 447 aa, Artificial Sequence
  Mature PH20 36-482 with T at a position corresponding to amino acid residue 287
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELTYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 549 - protein, 447 aa, Artificial Sequence
  Mature PH20 36-482 with S at a position corresponding to amino acid residue 289
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYSFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 550 - protein, 447 aa, Artificial Sequence
  Mature PH20 36-482 with S at a position corresponding to amino acid residue 291
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFSETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 551 - protein, 447 aa, Artificial Sequence
  Mature PH20 36-482 with V at a position corresponding to amino acid residue 291
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFVETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 552 - protein, 447 aa, Artificial Sequence
  Mature PH20 36-482 with C at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGCTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 553 - protein, 447 aa, Artificial Sequence
  Mature PH20 36-482 with F at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGFTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 554 - protein, 447 aa, Artificial Sequence
  Mature PH20 36-482 with H at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGHTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 555 - protein, 447 aa, Artificial Sequence
  Mature PH20 36-482 with K at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGKTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 556 - protein, 447 aa, Artificial Sequence
  Mature PH20 36-482 with R at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGRTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 557 - protein, 447 aa, Artificial Sequence
  Mature PH20 36-482 with V at a position corresponding to amino acid residue 292
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGVTVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 558 - protein, 447 aa, Artificial Sequence
  Mature PH20 36-482 with A at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEAVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 559 - protein, 447 aa, Artificial Sequence
  Mature PH20 36-482 with C at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGECVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 560 - protein, 447 aa, Artificial Sequence
  Mature PH20 36-482 with D at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEDVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 561 - protein, 447 aa, Artificial Sequence
  Mature PH20 36-482 with F at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEFVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 562 - protein, 447 aa, Artificial Sequence
  Mature PH20 36-482 with K at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEKVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 563 - protein, 447 aa, Artificial Sequence
  Mature PH20 36-482 with M at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEMVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 564 - protein, 447 aa, Artificial Sequence
  Mature PH20 36-482 with P at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEPVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 565 - protein, 447 aa, Artificial Sequence
  Mature PH20 36-482 with Q at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEQVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 566 - protein, 447 aa, Artificial Sequence
  Mature PH20 36-482 with V at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEVVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 567 - protein, 447 aa, Artificial Sequence
  Mature PH20 36-482 with Y at a position corresponding to amino acid residue 293
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGEYVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 568 - protein, 447 aa, Artificial Sequence
  Mature PH20 36-482 with G at a position corresponding to amino acid residue 298
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGGSGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 569 - protein, 447 aa, Artificial Sequence
  Mature PH20 36-482 with E at a position corresponding to amino acid residue 305
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWETLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 570 - protein, 447 aa, Artificial Sequence
  Mature PH20 36-482 with G at a position corresponding to amino acid residue 307
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTGSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 571 - protein, 447 aa, Artificial Sequence
  Mature PH20 36-482 with D at a position corresponding to amino acid residue 308
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLDIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 572 - protein, 447 aa, Artificial Sequence
  Mature PH20 36-482 with G at a position corresponding to amino acid residue 308
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLGIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 573 - protein, 447 aa, Artificial Sequence
  Mature PH20 36-482 with K at a position corresponding to amino acid residue 308
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLKIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 574 - protein, 447 aa, Artificial Sequence
  Mature PH20 36-482 with N at a position corresponding to amino acid residue 308
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLNIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 575 - protein, 447 aa, Artificial Sequence
  Mature PH20 36-482 with R at a position corresponding to amino acid residue 308
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLRIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 576 - protein, 447 aa, Artificial Sequence
  Mature PH20 36-482 with E at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSEMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 577 - protein, 447 aa, Artificial Sequence
  Mature PH20 36-482 with G at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSGMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 578 - protein, 447 aa, Artificial Sequence
  Mature PH20 36-482 with H at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSHMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 579 - protein, 447 aa, Artificial Sequence
  Mature PH20 36-482 with L at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSLMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 580 - protein, 447 aa, Artificial Sequence
  Mature PH20 36-482 with M at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSMMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 581 - protein, 447 aa, Artificial Sequence
  Mature PH20 36-482 with N at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSNMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 582 - protein, 447 aa, Artificial Sequence
  Mature PH20 36-482 with Q at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSQMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 583 - protein, 447 aa, Artificial Sequence
  Mature PH20 36-482 with R at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSRMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 584 - protein, 447 aa, Artificial Sequence
  Mature PH20 36-482 with S at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSSMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 585 - protein, 447 aa, Artificial Sequence
  Mature PH20 36-482 with T at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSTMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 586 - protein, 447 aa, Artificial Sequence
  Mature PH20 36-482 with V at a position corresponding to amino acid residue 309
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSVMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 587 - protein, 447 aa, Artificial Sequence
  Mature PH20 36-482 with A at a position corresponding to amino acid residue 310
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIARSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 588 - protein, 447 aa, Artificial Sequence
  Mature PH20 36-482 with G at a position corresponding to amino acid residue 310
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIGRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 589 - protein, 447 aa, Artificial Sequence
  Mature PH20 36-482 with Q at a position corresponding to amino acid residue 310
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIQRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 590 - protein, 447 aa, Artificial Sequence
  Mature PH20 36-482 with S at a position corresponding to amino acid residue 310
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSISRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 591 - protein, 447 aa, Artificial Sequence
  Mature PH20 36-482 with A at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSAKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 592 - protein, 447 aa, Artificial Sequence
  Mature PH20 36-482 with G at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSGKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 593 - protein, 447 aa, Artificial Sequence
  Mature PH20 36-482 with H at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSHKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 594 - protein, 447 aa, Artificial Sequence
  Mature PH20 36-482 with K at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSKKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 595 - protein, 447 aa, Artificial Sequence
  Mature PH20 36-482 with P at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSPKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 596 - protein, 447 aa, Artificial Sequence
  Mature PH20 36-482 with R at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSRKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 597 - protein, 447 aa, Artificial Sequence
  Mature PH20 36-482 with T at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSTKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 598 - protein, 447 aa, Artificial Sequence
  Mature PH20 36-482 with Y at a position corresponding to amino acid residue 313
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSYKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 599 - protein, 447 aa, Artificial Sequence
  Mature PH20 36-482 with S at a position corresponding to amino acid residue 314
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMSSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 600 - protein, 447 aa, Artificial Sequence
  Mature PH20 36-482 with Y at a position corresponding to amino acid residue 314
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMYSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 601 - protein, 447 aa, Artificial Sequence
  Mature PH20 36-482 with A at a position corresponding to amino acid residue 315
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKACLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 602 - protein, 447 aa, Artificial Sequence
  Mature PH20 36-482 with H at a position corresponding to amino acid residue 315
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKHCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 603 - protein, 447 aa, Artificial Sequence
  Mature PH20 36-482 with Y at a position corresponding to amino acid residue 315
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKYCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 604 - protein, 447 aa, Artificial Sequence
  Mature PH20 36-482 with A at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCALLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 605 - protein, 447 aa, Artificial Sequence
  Mature PH20 36-482 with I at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCILLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 606 - protein, 447 aa, Artificial Sequence
  Mature PH20 36-482 with K at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCKLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 607 - protein, 447 aa, Artificial Sequence
  Mature PH20 36-482 with N at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCNLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 608 - protein, 447 aa, Artificial Sequence
  Mature PH20 36-482 with Q at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCQLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 609 - protein, 447 aa, Artificial Sequence
  Mature PH20 36-482 with R at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCRLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 610 - protein, 447 aa, Artificial Sequence
  Mature PH20 36-482 with S at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCSLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 611 - protein, 447 aa, Artificial Sequence
  Mature PH20 36-482 with T at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCTLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 612 - protein, 447 aa, Artificial Sequence
  Mature PH20 36-482 with W at a position corresponding to amino acid residue 317
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCWLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 613 - protein, 447 aa, Artificial Sequence
  Mature PH20 36-482 with M at a position corresponding to amino acid residue 318
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLMLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 614 - protein, 447 aa, Artificial Sequence
  Mature PH20 36-482 with D at a position corresponding to amino acid residue 318
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLDLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 615 - protein, 447 aa, Artificial Sequence
  Mature PH20 36-482 with H at a position corresponding to amino acid residue 318
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLHLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 616 - protein, 447 aa, Artificial Sequence
  Mature PH20 36-482 with K at a position corresponding to amino acid residue 318
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLKLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 617 - protein, 447 aa, Artificial Sequence
  Mature PH20 36-482 with R at a position corresponding to amino acid residue 318
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLRLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 618 - protein, 447 aa, Artificial Sequence
  Mature PH20 36-482 with H at a position corresponding to amino acid residue 320
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLHNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 619 - protein, 447 aa, Artificial Sequence
  Mature PH20 36-482 with K at a position corresponding to amino acid residue 320
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLKNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 620 - protein, 447 aa, Artificial Sequence
  Mature PH20 36-482 with R at a position corresponding to amino acid residue 320
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLRNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 621 - protein, 447 aa, Artificial Sequence
  Mature PH20 36-482 with R at a position corresponding to amino acid residue 321
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDRYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 622 - protein, 447 aa, Artificial Sequence
  Mature PH20 36-482 with S at a position corresponding to amino acid residue 321
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDSYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 623 - protein, 447 aa, Artificial Sequence
  Mature PH20 36-482 with N at a position corresponding to amino acid residue 324
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMNTILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 624 - protein, 447 aa, Artificial Sequence
  Mature PH20 36-482 with R at a position corresponding to amino acid residue 324
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMRTILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 625 - protein, 447 aa, Artificial Sequence
  Mature PH20 36-482 with A at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEAILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 626 - protein, 447 aa, Artificial Sequence
  Mature PH20 36-482 with D at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEDILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 627 - protein, 447 aa, Artificial Sequence
  Mature PH20 36-482 with E at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEEILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 628 - protein, 447 aa, Artificial Sequence
  Mature PH20 36-482 with G at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEGILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 629 - protein, 447 aa, Artificial Sequence
  Mature PH20 36-482 with H at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEHILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 630 - protein, 447 aa, Artificial Sequence
  Mature PH20 36-482 with K at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEKILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 631 - protein, 447 aa, Artificial Sequence
  Mature PH20 36-482 with M at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEMILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 632 - protein, 447 aa, Artificial Sequence
  Mature PH20 36-482 with N at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMENILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 633 - protein, 447 aa, Artificial Sequence
  Mature PH20 36-482 with Q at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEQILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 634 - protein, 447 aa, Artificial Sequence
  Mature PH20 36-482 with S at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMESILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 635 - protein, 447 aa, Artificial Sequence
  Mature PH20 36-482 with V at a position corresponding to amino acid residue 325
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMEVILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 636 - protein, 447 aa, Artificial Sequence
  Mature PH20 36-482 with L at a position corresponding to amino acid residue 326
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETLLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 637 - protein, 447 aa, Artificial Sequence
  Mature PH20 36-482 with V at a position corresponding to amino acid residue 326
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETVLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 638 - protein, 447 aa, Artificial Sequence
  Mature PH20 36-482 with C at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILCPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 639 - protein, 447 aa, Artificial Sequence
  Mature PH20 36-482 with G at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILGPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 640 - protein, 447 aa, Artificial Sequence
  Mature PH20 36-482 with K at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILKPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 641 - protein, 447 aa, Artificial Sequence
  Mature PH20 36-482 with L at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILLPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 642 - protein, 447 aa, Artificial Sequence
  Mature PH20 36-482 with I at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILIPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 643 - protein, 447 aa, Artificial Sequence
  Mature PH20 36-482 with S at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILSPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 644 - protein, 447 aa, Artificial Sequence
  Mature PH20 36-482 with Y at a position corresponding to amino acid residue 328
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILYPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 645 - protein, 447 aa, Artificial Sequence
  Mature PH20 36-482 with S at a position corresponding to amino acid residue 335
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVSLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 646 - protein, 447 aa, Artificial Sequence
  Mature PH20 36-482 with A at a position corresponding to amino acid residue 347
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCAEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 647 - protein, 447 aa, Artificial Sequence
  Mature PH20 36-482 with G at a position corresponding to amino acid residue 347
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCGEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 648 - protein, 447 aa, Artificial Sequence
  Mature PH20 36-482 with S at a position corresponding to amino acid residue 347
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCSEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 649 - protein, 447 aa, Artificial Sequence
  Mature PH20 36-482 with M at a position corresponding to amino acid residue 349
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEMGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 650 - protein, 447 aa, Artificial Sequence
  Mature PH20 36-482 with R at a position corresponding to amino acid residue 349
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQERGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 651 - protein, 447 aa, Artificial Sequence
  Mature PH20 36-482 with S at a position corresponding to amino acid residue 351
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGSCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 652 - protein, 447 aa, Artificial Sequence
  Mature PH20 36-482 with V at a position corresponding to amino acid residue 353
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCVRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 653 - protein, 447 aa, Artificial Sequence
  Mature PH20 36-482 with H at a position corresponding to amino acid residue 356
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKHWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 654 - protein, 447 aa, Artificial Sequence
  Mature PH20 36-482 with S at a position corresponding to amino acid residue 356
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKSWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 655 - protein, 447 aa, Artificial Sequence
  Mature PH20 36-482 with E at a position corresponding to amino acid residue 359
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNESDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 656 - protein, 447 aa, Artificial Sequence
  Mature PH20 36-482 with H at a position corresponding to amino acid residue 359
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNHSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 657 - protein, 447 aa, Artificial Sequence
  Mature PH20 36-482 with T at a position corresponding to amino acid residue 359
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNTSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 658 - protein, 447 aa, Artificial Sequence
  Mature PH20 36-482 with A at a position corresponding to amino acid residue 367
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNADNFAIQLEKGGKFTVRGKPTLEDLEQFSEKFYCSCYSTLSCKEKADVKDTDAVDVCIADGVCIDAFLKPPMETEEPQIFY

SEQ ID NO: 659 - protein, 447 aa, Artificial Sequence
  Mature PH20 36-482 with G at a position corresponding to amino acid residue 367
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNGDNFAIQLEKGGKFTVRGKPTLEDLEQFSEKFYCSCYSTLSCKEKADVKDTDAVDVCIADGVCIDAFLKPPMETEEPQIFY

SEQ ID NO: 660 - protein, 447 aa, Artificial Sequence
  Mature PH20 36-482 with K at a position corresponding to amino acid residue 367
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNKDNFAIQLEKGGKFTVRGKPTLEDLEQFSEKFYCSCYSTLSCKEKADVKDTDAVDVCIADGVCIDAFLKPPMETEEPQIFY

SEQ ID NO: 661 - protein, 447 aa, Artificial Sequence
  Mature PH20 36-482 with S at a position corresponding to amino acid residue 367
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNSDNFAIQLEKGGKFTVRGKPTLEDLEQFSEKFYCSCYSTLSCKEKADVKDTDAVDVCIADGVCIDAFLKPPMETEEPQIFY

SEQ ID NO: 662 - protein, 447 aa, Artificial Sequence
  Mature PH20 36-482 with A at a position corresponding to amino acid residue 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPANFAIQLEKGGKFTVRGKPTLEDLEQFSEKFYCSCYSTLSCKEKADVKDTDAVDVCIADGVCIDAFLKPPMETEEPQIFY

SEQ ID NO: 663 - protein, 447 aa, Artificial Sequence
  Mature PH20 36-482 with E at a position corresponding to amino acid residue 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPENFAIQLEKGGKFTVRGKPTLEDLEQFSEKFYCSCYSTLSCKEKADVKDTDAVDVCIADGVCIDAFLKPPMETEEPQIFY

SEQ ID NO: 664 - protein, 447 aa, Artificial Sequence
  Mature PH20 36-482 with K at a position corresponding to amino acid residue 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPKNFAIQLEKGGKFTVRGKPTLEDLEQFSEKFYCSCYSTLSCKEKADVKDTDAVDVCIADGVCIDAFLKPPMETEEPQIFY

SEQ ID NO: 665 - protein, 447 aa, Artificial Sequence
  Mature PH20 36-482 with L at a position corresponding to amino acid position 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPLNFAIQLEKGGKFTVRGKPTLEDLEQFSEKFYCSCYSTLSCKEKADVKDTDAVDVCIADGVCIDAFLKPPMETEEPQIFY

SEQ ID NO: 666 - protein, 447 aa, Artificial Sequence
  Mature PH20 36-482 with M at a position corresponding to amino acid position 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPMNFAIQLEKGGKFTVRGKPTLEDLEQFSEKFYCSCYSTLSCKEKADVKDTDAVDVCIADGVCIDAFLKPPMETEEPQIFY

SEQ ID NO: 667 - protein, 447 aa, Artificial Sequence
  Mature PH20 36-482 with R at a position corresponding to amino acid residue 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPRNFAIQLEKGGKFTVRGKPTLEDLEQFSEKFYCSCYSTLSCKEKADVKDTDAVDVCIADGVCIDAFLKPPMETEEPQIFY

SEQ ID NO: 668 - protein, 447 aa, Artificial Sequence
  Mature PH20 36-482 with T at a position corresponding to amino acid position 368
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPTNFAIQLEKGGKFTVRGKPTLEDLEQFSEKFYCSCYSTLSCKEKADVKDTDAVDVCIADGVCIDAFLKPPMETEEPQIFY

SEQ ID NO: 669 - protein, 447 aa, Artificial Sequence
  Mature PH20 36-482 with H at a position corresponding to amino acid residue 369
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDHFAIQLEKGGKFTVRGKPTLEDLEQFSEKFYCSCYSTLSCKEKADVKDTDAVDVCIADGVCIDAFLKPPMETEEPQIFY

SEQ ID NO: 670 - protein, 447 aa, Artificial Sequence
  Mature PH20 36-482 with R at a position corresponding to amino acid residue 369
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDRFAIQLEKGGKFTVRGKPTLEDLEQFSEKFYCSCYSTLSCKEKADVKDTDAVDVCIADGVCIDAFLKPPMETEEPQIFY

SEQ ID NO: 671 - protein, 447 aa, Artificial Sequence
  Mature PH20 36-482 with F at a position corresponding to amino acid residue 371
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFFIQLEKGGKFTVRGKPTLEDLEQFSEKFYCSCYSTLSCKEKADVKDTDAVDVCIADGVCIDAFLKPPMETEEPQIFY

SEQ ID NO: 672 - protein, 447 aa, Artificial Sequence
  Mature PH20 36-482 with H at a position corresponding to amino acid residue 371;
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFHIQLEKGGKFTVRGKPTLEDLEQFSEKFYCSCYSTLSCKEKADVKDTDAVDVCIADGVCIDAFLKPPMETEEPQIFY

SEQ ID NO: 673 - protein, 447 aa, Artificial Sequence
  Mature PH20 36-482 with K at a position corresponding to amino acid residue 371
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFKIQLEKGGKFTVRGKPTLEDLEQFSEKFYCSCYSTLSCKEKADVKDTDAVDVCIADGVCIDAFLKPPMETEEPQIFY

SEQ ID NO: 674 - protein, 447 aa, Artificial Sequence
  Mature PH20 36-482 with L at a position corresponding to amino acid residue 371
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFLIQLEKGGKFTVRGKPTLEDLEQFSEKFYCSCYSTLSCKEKADVKDTDAVDVCIADGVCIDAFLKPPMETEEPQIFY

SEQ ID NO: 675 - protein, 447 aa, Artificial Sequence
  Mature PH20 36-482 with R at a position corresponding to amino acid residue 371
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFRIQLEKGGKFTVRGKPTLEDLEQFSEKFYCSCYSTLSCKEKADVKDTDAVDVCIADGVCIDAFLKPPMETEEPQIFY

SEQ ID NO: 676 - protein, 447 aa, Artificial Sequence
  Mature PH20 36-482 with S at a position corresponding to amino acid residue 371
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFSIQLEKGGKFTVRGKPTLEDLEQFSEKFYCSCYSTLSCKEKADVKDTDAVDVCIADGVCIDAFLKPPMETEEPQIFY

SEQ ID NO: 677 - protein, 447 aa, Artificial Sequence
  Mature PH20 36-482 with M at a position corresponding to amino acid residue 373
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIMLEKGGKFTVRGKPTLEDLEQFSEKFYCSCYSTLSCKEKADVKDTDAVDVCIADGVCIDAFLKPPMETEEPQIFY

SEQ ID NO: 678 - protein, 447 aa, Artificial Sequence
  Mature PH20 36-482 with H at a position corresponding to amino acid residue 374
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQHEKGGKFTVRGKPTLEDLEQFSEKFYCSCYSTLSCKEKADVKDTDAVDVCIADGVCIDAFLKPPMETEEPQIFY

SEQ ID NO: 679 - protein, 447 aa, Artificial Sequence
  Mature PH20 36-482 with P at a position corresponding to amino acid residue 374
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQPEKGGKFTVRGKPTLEDLEQFSEKFYCSCYSTLSCKEKADVKDTDAVDVCIADGVCIDAFLKPPMETEEPQIFY

SEQ ID NO: 680 - protein, 447 aa, Artificial Sequence
  Mature PH20 36-482 with A at a position corresponding to amino acid residue 375
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLAKGGKFTVRGKPTLEDLEQFSEKFYCSCYSTLSCKEKADVKDTDAVDVCIADGVCIDAFLKPPMETEEPQIFY

SEQ ID NO: 681 - protein, 447 aa, Artificial Sequence
  Mature PH20 36-482 with G at a position corresponding to amino acid residue 375
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLGKGGKFTVRGKPTLEDLEQFSEKFYCSCYSTLSCKEKADVKDTDAVDVCIADGVCIDAFLKPPMETEEPQIFY

SEQ ID NO: 682 - protein, 447 aa, Artificial Sequence
  Mature PH20 36-482 with K at a position corresponding to amino acid residue 375
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLKKGGKFTVRGKPTLEDLEQFSEKFYCSCYSTLSCKEKADVKDTDAVDVCIADGVCIDAFLKPPMETEEPQIFY

SEQ ID NO: 683 - protein, 447 aa, Artificial Sequence
  Mature PH20 36-482 with R at a position corresponding to amino acid residue 375
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLRKGGKFTVRGKPTLEDLEQFSEKFYCSCYSTLSCKEKADVKDTDAVDVCIADGVCIDAFLKPPMETEEPQIFY

SEQ ID NO: 684 - protein, 447 aa, Artificial Sequence
  Mature PH20 36-482 with D at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEDGGKFTVRGKPTLEDLEQFSEKFYCSCYSTLSCKEKADVKDTDAVDVCIADGVCIDAFLKPPMETEEPQIFY

SEQ ID NO: 685 - protein, 447 aa, Artificial Sequence
  Mature PH20 36-482 with E at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEEGGKFTVRGKPTLEDLEQFSEKFYCSCYSTLSCKEKADVKDTDAVDVCIADGVCIDAFLKPPMETEEPQIFY

SEQ ID NO: 686 - protein, 447 aa, Artificial Sequence
  Mature PH20 36-482 with Q at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEQGGKFTVRGKPTLEDLEQFSEKFYCSCYSTLSCKEKADVKDTDAVDVCIADGVCIDAFLKPPMETEEPQIFY

SEQ ID NO: 687 - protein, 447 aa, Artificial Sequence
  Mature PH20 36-482 with R at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLERGGKFTVRGKPTLEDLEQFSEKFYCSCYSTLSCKEKADVKDTDAVDVCIADGVCIDAFLKPPMETEEPQIFY

SEQ ID NO: 688 - protein, 447 aa, Artificial Sequence
  Mature PH20 36-482 with T at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLETGGKFTVRGKPTLEDLEQFSEKFYCSCYSTLSCKEKADVKDTDAVDVCIADGVCIDAFLKPPMETEEPQIFY

SEQ ID NO: 689 - protein, 447 aa, Artificial Sequence
  Mature PH20 36-482 with V at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEVGGKFTVRGKPTLEDLEQFSEKFYCSCYSTLSCKEKADVKDTDAVDVCIADGVCIDAFLKPPMETEEPQIFY

SEQ ID NO: 690 - protein, 447 aa, Artificial Sequence
  Mature PH20 36-482 with Y at a position corresponding to amino acid residue 376
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEYGGKFTVRGKPTLEDLEQFSEKFYCSCYSTLSCKEKADVKDTDAVDVCIADGVCIDAFLKPPMETEEPQIFY

SEQ ID NO: 691 - protein, 447 aa, Artificial Sequence
  Mature PH20 36-482 with D at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKDGKFTVRGKPTLEDLEQFSEKFYCSCYSTLSCKEKADVKDTDAVDVCIADGVCIDAFLKPPMETEEPQIFY

SEQ ID NO: 692 - protein, 447 aa, Artificial Sequence
  Mature PH20 36-482 with E at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKEGKFTVRGKPTLEDLEQFSEKFYCSCYSTLSCKEKADVKDTDAVDVCIADGVCIDAFLKPPMETEEPQIFY

SEQ ID NO: 693 - protein, 447 aa, Artificial Sequence
  Mature PH20 36-482 with H at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKHGKFTVRGKPTLEDLEQFSEKFYCSCYSTLSCKEKADVKDTDAVDVCIADGVCIDAFLKPPMETEEPQIFY

SEQ ID NO: 694 - protein, 447 aa, Artificial Sequence
  Mature PH20 36-482 with K at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKKGKFTVRGKPTLEDLEQFSEKFYCSCYSTLSCKEKADVKDTDAVDVCIADGVCIDAFLKPPMETEEPQIFY

SEQ ID NO: 695 - protein, 447 aa, Artificial Sequence
  Mature PH20 36-482 with P at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKPGKFTVRGKPTLEDLEQFSEKFYCSCYSTLSCKEKADVKDTDAVDVCIADGVCIDAFLKPPMETEEPQIFY

SEQ ID NO: 696 - protein, 447 aa, Artificial Sequence
  Mature PH20 36-482 with R at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKRGKFTVRGKPTLEDLEQFSEKFYCSCYSTLSCKEKADVKDTDAVDVCIADGVCIDAFLKPPMETEEPQIFY

SEQ ID NO: 697 - protein, 447 aa, Artificial Sequence
  Mature PH20 36-482 with S at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKSGKFTVRGKPTLEDLEQFSEKFYCSCYSTLSCKEKADVKDTDAVDVCIADGVCIDAFLKPPMETEEPQIFY

SEQ ID NO: 698 - protein, 447 aa, Artificial Sequence
  Mature PH20 36-482 with T at a position corresponding to amino acid residue 377
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKTGKFTVRGKPTLEDLEQFSEKFYCSCYSTLSCKEKADVKDTDAVDVCIADGVCIDAFLKPPMETEEPQIFY

SEQ ID NO: 699 - protein, 447 aa, Artificial Sequence
  Mature PH20 36-482 with W at a position corresponding to amino acid residue 380
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKWTVRGKPTLEDLEQFSEKFYCSCYSTLSCKEKADVKDTDAVDVCIADGVCIDAFLKPPMETEEPQIFY

SEQ ID NO: 700 - protein, 447 aa, Artificial Sequence
  Mature PH20 36-482 with Y at a position corresponding to amino acid residue 380
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKYTVRGKPTLEDLEQFSEKFYCSCYSTLSCKEKADVKDTDAVDVCIADGVCIDAFLKPPMETEEPQIFY

SEQ ID NO: 701 - protein, 447 aa, Artificial Sequence
  Mature PH20 36-482 with S at a position corresponding to amino acid residue 381
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFSVRGKPTLEDLEQFSEKFYCSCYSTLSCKEKADVKDTDAVDVCIADGVCIDAFLKPPMETEEPQIFY

SEQ ID NO: 702 - protein, 447 aa, Artificial Sequence
  Mature PH20 36-482 with I at a position corresponding to amino acid residue 383
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVIGKPTLEDLEQFSEKFYCSCYSTLSCKEKADVKDTDAVDVCIADGVCIDAFLKPPMETEEPQIFY

SEQ ID NO: 703 - protein, 447 aa, Artificial Sequence
  Mature PH20 36-482 with K at a position corresponding to amino acid residue 383
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVKGKPTLEDLEQFSEKFYCSCYSTLSCKEKADVKDTDAVDVCIADGVCIDAFLKPPMETEEPQIFY

SEQ ID NO: 704 - protein, 447 aa, Artificial Sequence
  Mature PH20 36-482 with L at a position corresponding to amino acid residue 383
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVLGKPTLEDLEQFSEKFYCSCYSTLSCKEKADVKDTDAVDVCIADGVCIDAFLKPPMETEEPQIFY

SEQ ID NO: 705 - protein, 447 aa, Artificial Sequence
  Mature PH20 36-482 with S at a position corresponding to amino acid residue 383
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVSGKPTLEDLEQFSEKFYCSCYSTLSCKEKADVKDTDAVDVCIADGVCIDAFLKPPMETEEPQIFY

SEQ ID NO: 706 - protein, 447 aa, Artificial Sequence
  Mature PH20 36-482 with A at a position corresponding to amino acid residue 385
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGAPTLEDLEQFSEKFYCSCYSTLSCKEKADVKDTDAVDVCIADGVCIDAFLKPPMETEEPQIFY

SEQ ID NO: 707 - protein, 447 aa, Artificial Sequence
  Mature PH20 36-482 with Q at a position corresponding to amino acid residue 385
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGQPTLEDLEQFSEKFYCSCYSTLSCKEKADVKDTDAVDVCIADGVCIDAFLKPPMETEEPQIFY

SEQ ID NO: 708 - protein, 447 aa, Artificial Sequence
  Mature PH20 36-482 with V at a position corresponding to amino acid residue 385
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGVPTLEDLEQFSEKFYCSCYSTLSCKEKADVKDTDAVDVCIADGVCIDAFLKPPMETEEPQIFY

SEQ ID NO: 709 - protein, 447 aa, Artificial Sequence
  Mature PH20 36-482 with A at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLADLEQFSEKFYCSCYSTLSCKEKADVKDTDAVDVCIADGVCIDAFLKPPMETEEPQIFY

SEQ ID NO: 710 - protein, 447 aa, Artificial Sequence
  Mature PH20 36-482 with G at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLGDLEQFSEKFYCSCYSTLSCKEKADVKDTDAVDVCIADGVCIDAFLKPPMETEEPQIFY

SEQ ID NO: 711 - protein, 447 aa, Artificial Sequence
  Mature PH20 36-482 with L at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLLDLEQFSEKFYCSCYSTLSCKEKADVKDTDAVDVCIADGVCIDAFLKPPMETEEPQIFY

SEQ ID NO: 712 - protein, 447 aa, Artificial Sequence
  Mature PH20 36-482 with K at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLKDLEQFSEKFYCSCYSTLSCKEKADVKDTDAVDVCIADGVCIDAFLKPPMETEEPQIFY

SEQ ID NO: 713 - protein, 447 aa, Artificial Sequence
  Mature PH20 36-482 with Q at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLQDLEQFSEKFYCSCYSTLSCKEKADVKDTDAVDVCIADGVCIDAFLKPPMETEEPQIFY

SEQ ID NO: 714 - protein, 447 aa, Artificial Sequence
  Mature PH20 36-482 with S at a position corresponding to amino acid residue 389
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLSDLEQFSEKFYCSCYSTLSCKEKADVKDTDAVDVCIADGVCIDAFLKPPMETEEPQIFY

SEQ ID NO: 715 - protein, 447 aa, Artificial Sequence
  Mature PH20 36-482 with A at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLAQFSEKFYCSCYSTLSCKEKADVKDTDAVDVCIADGVCIDAFLKPPMETEEPQIFY

SEQ ID NO: 716 - protein, 447 aa, Artificial Sequence
  Mature PH20 36-482 with F at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLFQFSEKFYCSCYSTLSCKEKADVKDTDAVDVCIADGVCIDAFLKPPMETEEPQIFY

SEQ ID NO: 717 - protein, 447 aa, Artificial Sequence
  Mature PH20 36-482 with M at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLMQFSEKFYCSCYSTLSCKEKADVKDTDAVDVCIADGVCIDAFLKPPMETEEPQIFY

SEQ ID NO: 718 - protein, 447 aa, Artificial Sequence
  Mature PH20 36-482 with Q at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLQQFSEKFYCSCYSTLSCKEKADVKDTDAVDVCIADGVCIDAFLKPPMETEEPQIFY

SEQ ID NO: 719 - protein, 447 aa, Artificial Sequence
  Mature PH20 36-482 with R at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLRQFSEKFYCSCYSTLSCKEKADVKDTDAVDVCIADGVCIDAFLKPPMETEEPQIFY

SEQ ID NO: 720 - protein, 447 aa, Artificial Sequence
  Mature PH20 36-482 with V at a position corresponding to amino acid residue 392
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLVQFSEKFYCSCYSTLSCKEKADVKDTDAVDVCIADGVCIDAFLKPPMETEEPQIFY

SEQ ID NO: 721 - protein, 447 aa, Artificial Sequence
  Mature PH20 36-482 with F at a position corresponding to amino acid residue 393
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEFFSEKFYCSCYSTLSCKEKADVKDTDAVDVCIADGVCIDAFLKPPMETEEPQIFY

SEQ ID NO: 722 - protein, 447 aa, Artificial Sequence
  Mature PH20 36-482 with M at a position corresponding to amino acid residue 393
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEMFSEKFYCSCYSTLSCKEKADVKDTDAVDVCIADGVCIDAFLKPPMETEEPQIFY

SEQ ID NO: 723 - protein, 447 aa, Artificial Sequence
  Mature PH20 36-482 with A at a position corresponding to amino acid residue 395
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFAEKFYCSCYSTLSCKEKADVKDTDAVDVCIADGVCIDAFLKPPMETEEPQIFY

SEQ ID NO: 724 - protein, 447 aa, Artificial Sequence
  Mature PH20 36-482 with H at a position corresponding to amino acid residue 395
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFHEKFYCSCYSTLSCKEKADVKDTDAVDVCIADGVCIDAFLKPPMETEEPQIFY

SEQ ID NO: 725 - protein, 447 aa, Artificial Sequence
  Mature PH20 36-482 with R at a position corresponding to amino acid residue 395
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFREKFYCSCYSTLSCKEKADVKDTDAVDVCIADGVCIDAFLKPPMETEEPQIFY

SEQ ID NO: 726 - protein, 447 aa, Artificial Sequence
  Mature PH20 36-482 with A at a position corresponding to amino acid residue 396
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSAKFYCSCYSTLSCKEKADVKDTDAVDVCIADGVCIDAFLKPPMETEEPQIFY

SEQ ID NO: 727 - protein, 447 aa, Artificial Sequence
  Mature PH20 36-482 with H at a position corresponding to amino acid residue 396
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSHKFYCSCYSTLSCKEKADVKDTDAVDVCIADGVCIDAFLKPPMETEEPQIFY

SEQ ID NO: 728 - protein, 447 aa, Artificial Sequence
  Mature PH20 36-482 with Q at a position corresponding to amino acid residue 396
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSQKFYCSCYSTLSCKEKADVKDTDAVDVCIADGVCIDAFLKPPMETEEPQIFY

SEQ ID NO: 729 - protein, 447 aa, Artificial Sequence
  Mature PH20 36-482 with S at a position corresponding to amino acid residue 396
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSSKFYCSCYSTLSCKEKADVKDTDAVDVCIADGVCIDAFLKPPMETEEPQIFY

SEQ ID NO: 730 - protein, 447 aa, Artificial Sequence
  Mature PH20 36-482 with K at a position corresponding to amino acid residue 399
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFKCSCYSTLSCKEKADVKDTDAVDVCIADGVCIDAFLKPPMETEEPQIFY

SEQ ID NO: 731 - protein, 447 aa, Artificial Sequence
  Mature PH20 36-482 with M at a position corresponding to amino acid residue 399
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFMCSCYSTLSCKEKADVKDTDAVDVCIADGVCIDAFLKPPMETEEPQIFY

SEQ ID NO: 732 - protein, 447 aa, Artificial Sequence
  Mature PH20 36-482 with T at a position corresponding to amino acid residue 399
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFTCSCYSTLSCKEKADVKDTDAVDVCIADGVCIDAFLKPPMETEEPQIFY

SEQ ID NO: 733 - protein, 447 aa, Artificial Sequence
  Mature PH20 36-482 with V at a position corresponding to amino acid residue 399
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFVCSCYSTLSCKEKADVKDTDAVDVCIADGVCIDAFLKPPMETEEPQIFY

SEQ ID NO: 734 - protein, 447 aa, Artificial Sequence
  Mature PH20 36-482 with W at a position corresponding to amino acid residue 399
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFWCSCYSTLSCKEKADVKDTDAVDVCIADGVCIDAFLKPPMETEEPQIFY

SEQ ID NO: 735 - protein, 447 aa, Artificial Sequence
  Mature PH20 36-482 with A at a position corresponding to amino acid residue 401
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCACYSTLSCKEKADVKDTDAVDVCIADGVCIDAFLKPPMETEEPQIFY

SEQ ID NO: 736 - protein, 447 aa, Artificial Sequence
  Mature PH20 36-482 with E at a position corresponding to amino acid residue 401
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCECYSTLSCKEKADVKDTDAVDVCIADGVCIDAFLKPPMETEEPQIFY

SEQ ID NO: 737 - protein, 447 aa, Artificial Sequence
  Mature PH20 36-482 with A at a position corresponding to amino acid residue 404
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYATLSCKEKADVKDTDAVDVCIADGVCIDAFLKPPMETEEPQIFY

SEQ ID NO: 738 - protein, 447 aa, Artificial Sequence
  Mature PH20 36-482 with G at a position corresponding to amino acid residue 405
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSGLSCKEKADVKDTDAVDVCIADGVCIDAFLKPPMETEEPQIFY

SEQ ID NO: 739 - protein, 447 aa, Artificial Sequence
  Mature PH20 36-482 with F at a position corresponding to amino acid residue 406
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTFSCKEKADVKDTDAVDVCIADGVCIDAFLKPPMETEEPQIFY

SEQ ID NO: 740 - protein, 447 aa, Artificial Sequence
  Mature PH20 36-482 with N at a position corresponding to amino acid residue 406
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTNSCKEKADVKDTDAVDVCIADGVCIDAFLKPPMETEEPQIFY

SEQ ID NO: 741 - protein, 447 aa, Artificial Sequence
  Mature PH20 36-482 with A at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLACKEKADVKDTDAVDVCIADGVCIDAFLKPPMETEEPQIFY

SEQ ID NO: 742 - protein, 447 aa, Artificial Sequence
  Mature PH20 36-482 with D at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLDCKEKADVKDTDAVDVCIADGVCIDAFLKPPMETEEPQIFY

SEQ ID NO: 743 - protein, 447 aa, Artificial Sequence
  Mature PH20 36-482 with E at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLECKEKADVKDTDAVDVCIADGVCIDAFLKPPMETEEPQIFY

SEQ ID NO: 744 - protein, 447 aa, Artificial Sequence
  Mature PH20 36-482 with F at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLFCKEKADVKDTDAVDVCIADGVCIDAFLKPPMETEEPQIFY

SEQ ID NO: 745 - protein, 447 aa, Artificial Sequence
  Mature PH20 36-482 with H at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLHCKEKADVKDTDAVDVCIADGVCIDAFLKPPMETEEPQIFY

SEQ ID NO: 746 - protein, 447 aa, Artificial Sequence
  Mature PH20 36-482 with Q at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLQCKEKADVKDTDAVDVCIADGVCIDAFLKPPMETEEPQIFY

SEQ ID NO: 747 - protein, 447 aa, Artificial Sequence
  Mature PH20 36-482 with P at a position corresponding to amino acid residue 407
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLPCKEKADVKDTDAVDVCIADGVCIDAFLKPPMETEEPQIFY

SEQ ID NO: 748 - protein, 447 aa, Artificial Sequence
  Mature PH20 36-482 with A at a position corresponding to amino acid residue 409
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCAEKADVKDTDAVDVCIADGVCIDAFLKPPMETEEPQIFY

SEQ ID NO: 749 - protein, 447 aa, Artificial Sequence
  Mature PH20 36-482 with Q at a position corresponding to amino acid residue 409
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCQEKADVKDTDAVDVCIADGVCIDAFLKPPMETEEPQIFY

SEQ ID NO: 750 - protein, 447 aa, Artificial Sequence
  Mature PH20 36-482 with T at a position corresponding to amino acid residue 410
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKTKADVKDTDAVDVCIADGVCIDAFLKPPMETEEPQIFY

SEQ ID NO: 751 - protein, 447 aa, Artificial Sequence
  Mature PH20 36-482 with Q at a position corresponding to amino acid residue 412
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKQDVKDTDAVDVCIADGVCIDAFLKPPMETEEPQIFY

SEQ ID NO: 752 - protein, 447 aa, Artificial Sequence
  Mature PH20 36-482 with R at a position corresponding to amino acid residue 412
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKRDVKDTDAVDVCIADGVCIDAFLKPPMETEEPQIFY

SEQ ID NO: 753 - protein, 447 aa, Artificial Sequence
  Mature PH20 36-482 with V at a position corresponding to amino acid residue 412
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKVDVKDTDAVDVCIADGVCIDAFLKPPMETEEPQIFY

SEQ ID NO: 754 - protein, 447 aa, Artificial Sequence
  Mature PH20 36-482 with L at a position corresponding to amino acid residue 416
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKLTDAVDVCIADGVCIDAFLKPPMETEEPQIFY

SEQ ID NO: 755 - protein, 447 aa, Artificial Sequence
  Mature PH20 36-482 with E at a position corresponding to amino acid residue 418
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTEAVDVCIADGVCIDAFLKPPMETEEPQIFY

SEQ ID NO: 756 - protein, 447 aa, Artificial Sequence
  Mature PH20 36-482 with L at a position corresponding to amino acid residue 418
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTLAVDVCIADGVCIDAFLKPPMETEEPQIFY

SEQ ID NO: 757 - protein, 447 aa, Artificial Sequence
  Mature PH20 36-482 with P at a position corresponding to amino acid residue 418
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTPAVDVCIADGVCIDAFLKPPMETEEPQIFY

SEQ ID NO: 758 - protein, 447 aa, Artificial Sequence
  Mature PH20 36-482 with R at a position corresponding to amino acid residue 418
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTRAVDVCIADGVCIDAFLKPPMETEEPQIFY

SEQ ID NO: 759 - protein, 447 aa, Artificial Sequence
  Mature PH20 36-482 with V at a position corresponding to amino acid residue 418
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTVAVDVCIADGVCIDAFLKPPMETEEPQIFY

SEQ ID NO: 760 - protein, 447 aa, Artificial Sequence
  Mature PH20 36-482 with F at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDFVDVCIADGVCIDAFLKPPMETEEPQIFY

SEQ ID NO: 761 - protein, 447 aa, Artificial Sequence
  Mature PH20 36-482 with H at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDHVDVCIADGVCIDAFLKPPMETEEPQIFY

SEQ ID NO: 762 - protein, 447 aa, Artificial Sequence
  Mature PH20 36-482 with I at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDIVDVCIADGVCIDAFLKPPMETEEPQIFY

SEQ ID NO: 763 - protein, 447 aa, Artificial Sequence
  Mature PH20 36-482 with K at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDKVDVCIADGVCIDAFLKPPMETEEPQIFY

SEQ ID NO: 764 - protein, 447 aa, Artificial Sequence
  Mature PH20 36-482 with R at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDRVDVCIADGVCIDAFLKPPMETEEPQIFY

SEQ ID NO: 765 - protein, 447 aa, Artificial Sequence
  Mature PH20 36-482 with S at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDSVDVCIADGVCIDAFLKPPMETEEPQIFY

SEQ ID NO: 766 - protein, 447 aa, Artificial Sequence
  Mature PH20 36-482 with Y at a position corresponding to amino acid residue 419
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDYVDVCIADGVCIDAFLKPPMETEEPQIFY

SEQ ID NO: 767 - protein, 447 aa, Artificial Sequence
  Mature PH20 36-482 with A at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVAVCIADGVCIDAFLKPPMETEEPQIFY

SEQ ID NO: 768 - protein, 447 aa, Artificial Sequence
  Mature PH20 36-482 with H at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVHVCIADGVCIDAFLKPPMETEEPQIFY

SEQ ID NO: 769 - protein, 447 aa, Artificial Sequence
  Mature PH20 36-482 with K at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVKVCIADGVCIDAFLKPPMETEEPQIFY

SEQ ID NO: 770 - protein, 447 aa, Artificial Sequence
  Mature PH20 36-482 with N at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVNVCIADGVCIDAFLKPPMETEEPQIFY

SEQ ID NO: 771 - protein, 447 aa, Artificial Sequence
  Mature PH20 36-482 with Q at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVQVCIADGVCIDAFLKPPMETEEPQIFY

SEQ ID NO: 772 - protein, 447 aa, Artificial Sequence
  Mature PH20 36-482 with R at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVRVCIADGVCIDAFLKPPMETEEPQIFY

SEQ ID NO: 773 - protein, 447 aa, Artificial Sequence
  Mature PH20 36-482 with S at a position corresponding to amino acid residue 421
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVSVCIADGVCIDAFLKPPMETEEPQIFY

SEQ ID NO: 774 - protein, 447 aa, Artificial Sequence
  Mature PH20 36-482 with G at a position corresponding to amino acid residue 425
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIGDGVCIDAFLKPPMETEEPQIFY

SEQ ID NO: 775 - protein, 447 aa, Artificial Sequence
  Mature PH20 36-482 with K at a position corresponding to amino acid residue 425
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIKDGVCIDAFLKPPMETEEPQIFY

SEQ ID NO: 776 - protein, 447 aa, Artificial Sequence
  Mature PH20 36-482 with Q at a position corresponding to amino acid residue 427
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADQVCIDAFLKPPMETEEPQIFY

SEQ ID NO: 777 - protein, 447 aa, Artificial Sequence
  Mature PH20 36-482 with T at a position corresponding to amino acid residue 427
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADTVCIDAFLKPPMETEEPQIFY

SEQ ID NO: 778 - protein, 447 aa, Artificial Sequence
  Mature PH20 36-482 with L at a position corresponding to amino acid residue 428
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGLCIDAFLKPPMETEEPQIFY

SEQ ID NO: 779 - protein, 447 aa, Artificial Sequence
  Mature PH20 36-482 with A at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIAAFLKPPMETEEPQIFY

SEQ ID NO: 780 - protein, 447 aa, Artificial Sequence
  Mature PH20 36-482 with G at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIGAFLKPPMETEEPQIFY

SEQ ID NO: 781 - protein, 447 aa, Artificial Sequence
  Mature PH20 36-482 with E at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIEAFLKPPMETEEPQIFY

SEQ ID NO: 782 - protein, 447 aa, Artificial Sequence
  Mature PH20 36-482 with H at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIHAFLKPPMETEEPQIFY

SEQ ID NO: 783 - protein, 447 aa, Artificial Sequence
  Mature PH20 36-482 with K at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIKAFLKPPMETEEPQIFY

SEQ ID NO: 784 - protein, 447 aa, Artificial Sequence
  Mature PH20 36-482 with L at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCILAFLKPPMETEEPQIFY

SEQ ID NO: 785 - protein, 447 aa, Artificial Sequence
  Mature PH20 36-482 with N at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCINAFLKPPMETEEPQIFY

SEQ ID NO: 786 - protein, 447 aa, Artificial Sequence
  Mature PH20 36-482 with Q at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIQAFLKPPMETEEPQIFY

SEQ ID NO: 787 - protein, 447 aa, Artificial Sequence
  Mature PH20 36-482 with R at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIRAFLKPPMETEEPQIFY

SEQ ID NO: 788 - protein, 447 aa, Artificial Sequence
  Mature PH20 36-482 with S at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCISAFLKPPMETEEPQIFY

SEQ ID NO: 789 - protein, 447 aa, Artificial Sequence
  Mature PH20 36-482 with V at a position corresponding to amino acid residue 431
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIVAFLKPPMETEEPQIFY

SEQ ID NO: 790 - protein, 447 aa, Artificial Sequence
  Mature PH20 36-482 with A at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAALKPPMETEEPQIFY

SEQ ID NO: 791 - protein, 447 aa, Artificial Sequence
  Mature PH20 36-482 with H at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAHLKPPMETEEPQIFY

SEQ ID NO: 792 - protein, 447 aa, Artificial Sequence
  Mature PH20 36-482 with I at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAILKPPMETEEPQIFY

SEQ ID NO: 793 - protein, 447 aa, Artificial Sequence
  Mature PH20 36-482 with K at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAKLKPPMETEEPQIFY

SEQ ID NO: 794 - protein, 447 aa, Artificial Sequence
  Mature PH20 36-482 with L at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDALLKPPMETEEPQIFY

SEQ ID NO: 795 - protein, 447 aa, Artificial Sequence
  Mature PH20 36-482 with R at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDARLKPPMETEEPQIFY

SEQ ID NO: 796 - protein, 447 aa, Artificial Sequence
  Mature PH20 36-482 with T at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDATLKPPMETEEPQIFY

SEQ ID NO: 797 - protein, 447 aa, Artificial Sequence
  Mature PH20 36-482 with V at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAVLKPPMETEEPQIFY

SEQ ID NO: 798 - protein, 447 aa, Artificial Sequence
  Mature PH20 36-482 with W at a position corresponding to amino acid residue 433
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAWLKPPMETEEPQIFY

SEQ ID NO: 799 - protein, 447 aa, Artificial Sequence
  Mature PH20 36-482 with K at a position corresponding to amino acid residue 436
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKKPMETEEPQIFY

SEQ ID NO: 800 - protein, 447 aa, Artificial Sequence
  Mature PH20 36-482 with I at a position corresponding to amino acid residue 437
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPIMETEEPQIFY

SEQ ID NO: 801 - protein, 447 aa, Artificial Sequence
  Mature PH20 36-482 with M at a position corresponding to amino acid residue 437
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPMMETEEPQIFY

SEQ ID NO: 802 - protein, 447 aa, Artificial Sequence
  Mature PH20 36-482 with A at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPAETEEPQIFY

SEQ ID NO: 803 - protein, 447 aa, Artificial Sequence
  Mature PH20 36-482 with D at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPDETEEPQIFY

SEQ ID NO: 804 - protein, 447 aa, Artificial Sequence
  Mature PH20 36-482 with E at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPEETEEPQIFY

SEQ ID NO: 805 - protein, 447 aa, Artificial Sequence
  Mature PH20 36-482 with L at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPLETEEPQIFY

SEQ ID NO: 806 - protein, 447 aa, Artificial Sequence
  Mature PH20 36-482 with N at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPNETEEPQIFY

SEQ ID NO: 807 - protein, 447 aa, Artificial Sequence
  Mature PH20 36-482 with T at a position corresponding to amino acid residue 438
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPTETEEPQIFY

SEQ ID NO: 808 - protein, 447 aa, Artificial Sequence
  Mature PH20 36-482 with A at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMATEEPQIFY

SEQ ID NO: 809 - protein, 447 aa, Artificial Sequence
  Mature PH20 36-482 with C at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMCTEEPQIFY

SEQ ID NO: 810 - protein, 447 aa, Artificial Sequence
  Mature PH20 36-482 with K at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMKTEEPQIFY

SEQ ID NO: 811 - protein, 447 aa, Artificial Sequence
  Mature PH20 36-482 with P at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMPTEEPQIFY

SEQ ID NO: 812 - protein, 447 aa, Artificial Sequence
  Mature PH20 36-482 with Q at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMQTEEPQIFY

SEQ ID NO: 813 - protein, 447 aa, Artificial Sequence
  Mature PH20 36-482 with T at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMTTEEPQIFY

SEQ ID NO: 814 - protein, 447 aa, Artificial Sequence
  Mature PH20 36-482 with V at a position corresponding to amino acid residue 439
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMVTEEPQIFY

SEQ ID NO: 815 - protein, 447 aa, Artificial Sequence
  Mature PH20 36-482 with D at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMEDEEPQIFY

SEQ ID NO: 816 - protein, 447 aa, Artificial Sequence
  Mature PH20 36-482 with H at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMEHEEPQIFY

SEQ ID NO: 817 - protein, 447 aa, Artificial Sequence
  Mature PH20 36-482 with M at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMEMEEPQIFY

SEQ ID NO: 818 - protein, 447 aa, Artificial Sequence
  Mature PH20 36-482 with P at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMEPEEPQIFY

SEQ ID NO: 819 - protein, 447 aa, Artificial Sequence
  Mature PH20 36-482 with R at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMEREEPQIFY

SEQ ID NO: 820 - protein, 447 aa, Artificial Sequence
  Mature PH20 36-482 with S at a position corresponding to amino acid residue 440
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMESEEPQIFY

SEQ ID NO: 821 - protein, 447 aa, Artificial Sequence
  Mature PH20 36-482 with A at a position corresponding to amino acid residue 441
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETAEPQIFY

SEQ ID NO: 822 - protein, 447 aa, Artificial Sequence
  Mature PH20 36-482 with F at a position corresponding to amino acid residue 441
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETFEPQIFY

SEQ ID NO: 823 - protein, 447 aa, Artificial Sequence
  Mature PH20 36-482 with C at a position corresponding to amino acid residue 442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETECPQIFY

SEQ ID NO: 824 - protein, 447 aa, Artificial Sequence
  Mature PH20 36-482 with G at a position corresponding to amino acid residue 442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEGPQIFY

SEQ ID NO: 825 - protein, 447 aa, Artificial Sequence
  Mature PH20 36-482 with R at a position corresponding to amino acid residue 442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETERPQIFY

SEQ ID NO: 826 - protein, 447 aa, Artificial Sequence
  Mature PH20 36-482 with A at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEAQIFY

SEQ ID NO: 827 - protein, 447 aa, Artificial Sequence
  Mature PH20 36-482 with E at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEEQIFY

SEQ ID NO: 828 - protein, 447 aa, Artificial Sequence
  Mature PH20 36-482 with F at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEFQIFY

SEQ ID NO: 829 - protein, 447 aa, Artificial Sequence
  Mature PH20 36-482 with G at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEGQIFY

SEQ ID NO: 830 - protein, 447 aa, Artificial Sequence
  Mature PH20 36-482 with M at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEMQIFY

SEQ ID NO: 831 - protein, 447 aa, Artificial Sequence
  Mature PH20 36-482 with N at a position corresponding to amino acid residue 443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEENQIFY

SEQ ID NO: 832 - protein, 447 aa, Artificial Sequence
  Mature PH20 36-482 with E at a position corresponding to amino acid residue 444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPEIFY

SEQ ID NO: 833 - protein, 447 aa, Artificial Sequence
  Mature PH20 36-482 with H at a position corresponding to amino acid residue 444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPHIFY

SEQ ID NO: 834 - protein, 447 aa, Artificial Sequence
  Mature PH20 36-482 with V at a position corresponding to amino acid residue 444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPVIFY

SEQ ID NO: 835 - protein, 447 aa, Artificial Sequence
  Mature PH20 36-482 with H at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQHFY

SEQ ID NO: 836 - protein, 447 aa, Artificial Sequence
  Mature PH20 36-482 with M at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQMFY

SEQ ID NO: 837 - protein, 447 aa, Artificial Sequence
  Mature PH20 36-482 with N at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQNFY

SEQ ID NO: 838 - protein, 447 aa, Artificial Sequence
  Mature PH20 36-482 with P at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQPFY

SEQ ID NO: 839 - protein, 447 aa, Artificial Sequence
  Mature PH20 36-482 with Q at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQQFY

SEQ ID NO: 840 - protein, 447 aa, Artificial Sequence
  Mature PH20 36-482 with S at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQSFY

SEQ ID NO: 841 - protein, 447 aa, Artificial Sequence
  Mature PH20 36-482 with T at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQTFY

SEQ ID NO: 842 - protein, 447 aa, Artificial Sequence
  Mature PH20 36-482 with V at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQVFY

SEQ ID NO: 843 - protein, 447 aa, Artificial Sequence
  Mature PH20 36-482 with W at a position corresponding to amino acid residue 445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQWFY

SEQ ID NO: 844 - protein, 447 aa, Artificial Sequence
  Mature PH20 36-482 with A at a position corresponding to amino acid residue 446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIAY

SEQ ID NO: 845 - protein, 447 aa, Artificial Sequence
  Mature PH20 36-482 with M at a position corresponding to amino acid residue 446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIMY

SEQ ID NO: 846 - protein, 447 aa, Artificial Sequence
  Mature PH20 36-482 with W at a position corresponding to amino acid residue 446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIWY

SEQ ID NO: 847 - protein, 447 aa, Artificial Sequence
  Mature PH20 36-482 with D at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFD

SEQ ID NO: 848 - protein, 447 aa, Artificial Sequence
  Mature PH20 36-482 with E at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFE

SEQ ID NO: 849 - protein, 447 aa, Artificial Sequence
  Mature PH20 36-482 with G at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFG

SEQ ID NO: 850 - protein, 447 aa, Artificial Sequence
  Mature PH20 36-482 with I at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFI

SEQ ID NO: 851 - protein, 447 aa, Artificial Sequence
  Mature PH20 36-482 with N at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFN

SEQ ID NO: 852 - protein, 447 aa, Artificial Sequence
  Mature PH20 36-482 with P at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFP

SEQ ID NO: 853 - protein, 447 aa, Artificial Sequence
  Mature PH20 36-482 with Q at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFQ

SEQ ID NO: 854 - protein, 447 aa, Artificial Sequence
  Mature PH20 36-482 with T at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFT

SEQ ID NO: 855 - protein, 447 aa, Artificial Sequence
  Mature PH20 36-482 with V at a position corresponding to amino acid residue 447
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFV

SEQ ID NO: 856 - protein, 509 aa, omascus leucogenys
  precursor PH20 isoform 1
  ref <308>: DATABASE ACCESSION NUMBER: NCBI: XP_003261317
  ref <309>: DATABASE ENTRY DATE: 2011-05-06
MGVLKFKHIFFRSFVKSNGISQIVFTFLLIPRCLTLNFRAPPVIPNVPFLWAWNAPSEFCLGKFDEPLDMSLFSLTGSPRINVTGQGVTIFYVDRLGYYPYIDSITGVTVNGGIPQKISLQDHLDKAKQDITFYMPVDNLGMAVIDWEEWRPTWARNWKPKDVYKNRSIELVQQQNVQLSLAEATEKAKQEFEKAGKDFMVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFVYARIVFTDQVLKFLSRDELVYTLGETVALGASGIVIWGSLSIVRSMKSCLLLDNYMETILNPYIINVTLAAKMCSQVLCQEQGVCIRKDWNSSDYLHLNPDNFAIQLEKGGKFTVRGKPTPEDLEQFSEKFYCSCYSTLSCKEKADVKDTDAVDVCIADGVCIDAFLKPPKETEESQIFYNASPSTLSATMFIVSILFLIISSVVSL

SEQ ID NO: 857 - protein, 474 aa, Nomascus leucogenys
  mature PH-20 isoform 1
LNFRAPPVIPNVPFLWAWNAPSEFCLGKFDEPLDMSLFSLTGSPRINVTGQGVTIFYVDRLGYYPYIDSITGVTVNGGIPQKISLQDHLDKAKQDITFYMPVDNLGMAVIDWEEWRPTWARNWKPKDVYKNRSIELVQQQNVQLSLAEATEKAKQEFEKAGKDFMVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFVYARIVFTDQVLKFLSRDELVYTLGETVALGASGIVIWGSLSIVRSMKSCLLLDNYMETILNPYIINVTLAAKMCSQVLCQEQGVCIRKDWNSSDYLHLNPDNFAIQLEKGGKFTVRGKPTPEDLEQFSEKFYCSCYSTLSCKEKADVKDTDAVDVCIADGVCIDAFLKPPKETEESQIFYNASPSTLSATMFIVSILFLIISSVVSL

SEQ ID NO: 858 - protein, 509 aa, Callithrix jacchus
  precursor PH-20
  ref <308>: DATABASE ACCESSION NUMBER: NCBI: XP_002752103
  ref <309>: DATABASE ENTRY DATE: 2012-06-08
MGVLKFKHIFFRSFVKSSGVSQIVFTFLLIPCSLTLNFRAPPIIPNVPFLWAWNAPSEFCLGKFDEPLDMSLFSLIGSPRINVTGQGVTIFYVDRLGYYPYIDPTTGAVVNGGIPQKIALQDHLDKVRKDIIFYMPVDNLGMGVIDWEEWRPTWARNWKPKDIYKNKSIEMVQQRNVQLNLTQATDIAKQEFEKAAKDFMLETIKLGKALRPNHLWGYYLFPDCYNHHYKKPDYNGSCFNIEIKRNNDLSWLWNESTALYPSIYLNTQQSAVAAMLYVRNRVQEAIRVSKTPNANSPLPVFVYARLVFTDQVLRFLSQDELVYTLGETVALGASGIVIWGSLSIMRSMKSCLLLDTYMETVLNPYIINTTLAAKMCSQVLCQEQGVCIRKDWNSSDYLHLNPDNFAIETEKGGKFTVRGKPTYEDLEQFSEKFYCSCYTSLSCKVKADVKDTDAVDVCIADGVCIDASLKPPKETEESSQIFYNPSSSTPSAAIFIVAILFFISCVVSL

SEQ ID NO: 859 - protein, 474 aa, Callithrix jacchus
  mature PH-20
LNFRAPPIIPNVPFLWAWNAPSEFCLGKFDEPLDMSLFSLIGSPRINVTGQGVTIFYVDRLGYYPYIDPTTGAVVNGGIPQKIALQDHLDKVRKDIIFYMPVDNLGMGVIDWEEWRPTWARNWKPKDIYKNKSIEMVQQRNVQLNLTQATDIAKQEFEKAAKDFMLETIKLGKALRPNHLWGYYLFPDCYNHHYKKPDYNGSCFNIEIKRNNDLSWLWNESTALYPSIYLNTQQSAVAAMLYVRNRVQEAIRVSKTPNANSPLPVFVYARLVFTDQVLRFLSQDELVYTLGETVALGASGIVIWGSLSIMRSMKSCLLLDTYMETVLNPYIINTTLAAKMCSQVLCQEQGVCIRKDWNSSDYLHLNPDNFAIETEKGGKFTVRGKPTYEDLEQFSEKFYCSCYTSLSCKVKADVKDTDAVDVCIADGVCIDASLKPPKETEESSQIFYNPSSSTPSAAIFIVAILFFISCVVSL

SEQ ID NO: 860 - protein, 511 aa, Pongo abelii
  precursor PH-20 isoform 1
  ref <308>: DATABASE ACCESSION NUMBER: NCBI: XP_002818442
  ref <309>: DATABASE ENTRY DATE: 2012-06-17
MGVLKFKHIFFRSFVKSSGVSQIVLTFLLIPCCLTLNFRAPPIIPNMPFLWAWNAPSEFCLGKFDEPLDMSLFSLIGSPRINVTGQAVTIFYVDRLGYYPYIDSITGVTVNGGIPQKISLQDHLDKAKKDILFYMPVDNLGMAVIDWEEWRPTWARNWKPKDVYKNRSIELVQQQNVQLNLTEATEKAKQEFEKAGKDFMVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFVYARIVFTDQVLKFLSQDELVYTFGETVALGASGIVIWGSLSIMRSMKSCLLLDNYMETILNPYIINVTLAAKMCSQVLCQEQGVCIRKDWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIWRLEVWDQGISRMGFF

SEQ ID NO: 861 - protein, 476 aa, Pongo abelii
  mature PH-20 isoform 1
LNFRAPPIIPNMPFLWAWNAPSEFCLGKFDEPLDMSLFSLIGSPRINVTGQAVTIFYVDRLGYYPYIDSITGVTVNGGIPQKISLQDHLDKAKKDILFYMPVDNLGMAVIDWEEWRPTWARNWKPKDVYKNRSIELVQQQNVQLNLTEATEKAKQEFEKAGKDFMVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFVYARIVFTDQVLKFLSQDELVYTFGETVALGASGIVIWGSLSIMRSMKSCLLLDNYMETILNPYIINVTLAAKMCSQVLCQEQGVCIRKDWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIWRLEVWDQGISRMGFF

SEQ ID NO: 862 - protein, 21 aa, Homo sapiens
  Human insulin A chain
GIVEQCCTSICSLYQLENYCN

SEQ ID NO: 863 - protein, 30 aa, Homo sapiens
  Human Insulin B chain
FVNQHLCGSHLVEALYLVCGERGFFYTPKT

SEQ ID NO: 864 - protein, 108 aa, Sus scrofa
  Preproinsulin
MALWTRLLPLLALLALWAPAPAQAFVNQHLCGSHLVEALYLVCGERGFFYTPKARREAENPQAGAVELGGGLGGLQALALEGPPQKRGIVEQCCTSICSLYQLENYCN

SEQ ID NO: 865 - protein, 30 aa, Homo sapiens
  Human Insulin B chain analog (Aspart Insulin)
FVNQHLCGSHLVEALYLVCGERGFFYTDKT

SEQ ID NO: 866 - protein, 30 aa, Homo sapiens
  Human Insulin B chain analog (Lispro insulin)
FVNQHLCGSHLVEALYLVCGERGFFYTKPT

SEQ ID NO: 867 - protein, 30 aa, Homo sapiens
  Human Insulin B chain analog (Glulisine insulin)
FVKQHLCGSHLVEALYLVCGERGFFYTPET

SEQ ID NO: 868 - protein, 22 aa, Artificial Sequence
  IgG kappa signal sequence
MDMRVPAQLLGLLLLWLPGARG

SEQ ID NO: 869 - protein, 509 aa, Pan troglodytes
  Precursor PH-20
  ref <308>: DATABASE ACCESSION NUMBER: GenBank: BAK62198
  ref <309>: DATABASE ENTRY DATE: 2011-08-20
MGVLKFKHIFFRSFVKSSGVSQIVFTFLLIPCCLTLNFRAPPVIPNVPFLWAWNAPSEFCLGKFDEPLDTSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYARNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVYIDAFLKPPMETEESQIFYNASPSTLSATMFIVSILFLIISSVASL

SEQ ID NO: 870 - protein, 474 aa, Pan troglodytes
  Mature PH-20
LNFRAPPVIPNVPFLWAWNAPSEFCLGKFDEPLDTSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYARNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVYIDAFLKPPMETEESQIFYNASPSTLSATMFIVSILFLIISSVASL

SEQ ID NO: 871 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 872 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 873 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 874 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 875 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 876 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 877 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 878 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 879 - protein, 412 aa, Mus musculus
  hyaluronidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 880 - protein, 435 aa, Sus scrofa
  hyaluronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 881 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 882 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 883 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 884 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 885 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 886 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 887 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 888 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 889 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 890 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 891 - protein, 793 aa, Arthrobacter sp
  hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 892 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 893 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 894 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 895 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 896 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 897 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 898 - protein, 807 aa, Staphylococcus aureus (strain COL)
  hyaluronan lyase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 899 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 900 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 901 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 902 - protein, 807 aa, Staphylococcus aureus (strain NCTC 8325); identical to SEQ ID NO: 898
  hyaluronan lyase

SEQ ID NO: 903 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 904 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 905 - protein, 807 aa, Staphylococcus aureus (strain USA300); identical to SEQ ID NO: 898
  hyaluronan lyase

SEQ ID NO: 906 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 907 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 908 - protein, 1067 aa, Streptococcus pneumoniae serotype 2 (strain D39/N)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 909 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 910 - protein, 780 aa, Streptococcus pyogenes serotype M2 (strain MGAS10)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 911 - protein, 868 aa, Streptococcus pyogenes serotype M4 (strain MGAS10)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 912 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 913 - protein, 556 aa, Streptococcus pyogenes serotype M12 (strain MGAS2)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 914 - protein, 635 aa, Streptococcus pyogenes serotype M12 (strain MGAS2)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 915 - protein, 828 aa, Streptococcus pyogenes serotype M12 (strain MGAS9)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 916 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 917 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 918 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 919 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 920 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 921 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 922 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 923 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 924 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 925 - DNA, 10690 bp, Artificial Sequence
  pLV-EF1a-PH20(F204P)-IRES-GFP-Bsd
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagataatacgactcactatagggcccgggttggatccgccaccatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtcctaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttactgataagctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggacccaccggtcgccaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

SEQ ID NO: 926 - DNA, 10703 bp, Artificial Sequence
  psPAX2
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcgggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaggacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaaatatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagatgggttggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaagcaagaatcctagctgtggaaagatacctaaaggatcaacagctcctagggatttggggttgctctggaaaactcatttgcaccactgctgtgccttggaatgctagttggagtaataaatctctggaacagatctggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaatcccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaaacaaccggtacctctagaactatagctagcagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 927 - DNA, 5824 bp, Artificial Sequence
  PMD2.G
ggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcaacagagatcgatctgtttccttgacactatgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccatacaagtcaaaatgcccaagagtcacaaggctattcaagcagacggttggatgtgtcatgcttccaaatgggtcactacttgtgatttccgctggtatggaccgaagtatataacacagtccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaactcaaatcctgcacaacagattcttcatgtttggaccaaatcaacttgtgataccatgctcaaagaggcctcaattatatttgagtttttaatttttatggaattcaccccaccagtgcaggctgcctatcagaaagtggtggctggtgtggctaatgccctggcccacaagtttcactaagctcgcttccttgctgtccaatttctattaaaggttccttggttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagccctgatgcctatgccttattcatccctcagaaaaggattcaagtagaggcttgatttggaggttaaagtttggctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgt

The invention claimed is:

1. A modified PH20 polypeptide that exhibits increased stability in the presence of a phenolic preservative, comprising an amino acid replacement in an unmodified PH20 polypeptide, wherein:
the amino acid replacement confers the increased stability;
the amino acid replacement is replacement with proline at a position corresponding to position 204 in a PH20 polypeptide with reference to amino acid residue positions set forth in SEQ ID NO:3;
corresponding amino acid positions are identified by alignment of the modified PH20 polypeptide with the polypeptide whose sequence is set forth in SEQ ID NO:3;
the modified PH20 polypeptide has at least 85% sequence identity to the sequence of amino acids set forth in SEQ ID NO: 3 or 7; and
stability is increased compared to the unmodified polypeptide without the amino acid replacement, wherein stability is measured by resistance to denaturation in the presence of a phenolic preservative.

2. The modified PH20 polypeptide of claim 1, wherein the unmodified PH20 polypeptide is a soluble PH20 polypeptide that consists of the sequence of amino acids set forth in any of SEQ ID NOS: 3, 7 and 32-66.

3. The modified PH20 polypeptide of claim 1, wherein:
the unmodified PH20 polypeptide consists of the sequence of amino acids set forth in SEQ ID NO:3 or 7; and
the modified PH20 polypeptide has at least 95% sequence identity to SEQ ID NO:3.

4. The modified PH20 polypeptide of claim 1, that has only up to 10 amino acid replacements compared to the polypeptide of SEQ ID NO: 7 or 3.

5. The modified PH20 polypeptide of claim 1, wherein the modified PH20 polypeptide exhibits at least 15% of the hyaluronidase activity in the presence of the phenolic preservative(s) for at least 4 hours compared to the hyaluronidase activity in the absence of the phenolic preservative(s), wherein the activity is compared under the same conditions except for the presence of the phenolic preservative(s).

6. The modified PH20 polypeptide of claim 1, wherein the modified PH20 polypeptide is stable in the presence of an anti-microbially effective amount of one or more phenolic preservatives.

7. The modified PH20 polypeptide of claim 6, wherein the anti-microbially effective amount is a total amount of one or more phenolic preservative agents as a percentage (%) of mass concentration (w/v) that is from about 0.05% to 0.6%.

8. The modified PH20 polypeptide of claim 1, wherein the phenolic preservative is selected from among one or more of phenol, metacresol (m-cresol), benzyl alcohol and a paraben.

9. The modified PH20 polypeptide of claim 1, wherein the preservative is a phenolic preservative that is m-cresol, phenol, or a combination of m-cresol and phenol.

10. The modified PH20 polypeptide of claim 1, further comprising at least one amino acid replacement at the amino acid position selected from the group consisting of 58, 10, 12, 20, 22, 26, 34, 36, 46, 50, 52, 68, 70, 74, 82, 83, 84, 86, 97, 127, 131, 138, 142, 143, 144, 166, 169, 174, 193, 195, 196, 205, 206, 213, 219, 234, 237, 238, 240, 249, 261, 267, 277, 279, 291, 309, 310, 314, 315, 317, 318, 347, 367, 375, 376, 399, 401, 407, 416, 419, 421, 431, 433, 439, 440, 443 and 445 with reference to amino acid positions set forth in SEQ ID NO:3, wherein amino acid position is identified by alignment of the modified PH20 polypeptide with SEQ ID NO:3.

11. The modified PH20 polypeptide of claim 10, comprising at least one amino acid replacement selected from the group consisting of: G at a position corresponding to position 10; K at a position corresponding to position 12; S at a position corresponding to position 20; T at a position corresponding to position 22; M at a position corresponding to position 26; W at a position corresponding to position 34; N at a position corresponding to position 36; L at a position corresponding to position 46; M at a position corresponding to position 50; T at a position corresponding to position 52; S at a position corresponding to position 52; C at a position corresponding to position 58; K at a position corresponding to position 58; R at a position corresponding to position 58; N at a position corresponding to position 58; Y at a position corresponding to position 58; P at a position corresponding to position 58; H at a position corresponding to position 58; P at a position corresponding to position 68; V at a position corresponding to position 70; E at a position corresponding to position 74; L at a position corresponding to position 82; N at a position corresponding to position 82; V at a position corresponding to position 83; Q at a position corresponding to position 83; S at a position corresponding to position 83; G at a position corresponding to position 83; N at a position corresponding to position 84; A at a position corresponding to position 86; K at a position corresponding to position 86; E at a position corresponding to position 97; L at a position corresponding to position 97; R at a position corresponding to position 127; R at a position corresponding to position 131; L at a position corresponding to position 138; K at a position corresponding to position 142; N at a position corresponding to position 142; P at a position corresponding to position 142; S at a position corresponding to position 142; T at a position corresponding to position 142; G at a position corresponding to position 143; K at a position corresponding to position 143; T at a position corresponding to position 144; Q at a position corresponding to position 166; T at a position corresponding to position 166; L at a position corresponding to position 169; G at a position corresponding to position 174; N at a position corresponding to position 174; Q at a position corresponding to position 193; T at a position corresponding to position 195; N at a position corresponding to position 195; E at a position corresponding to position 196; R at a position corresponding to position 196; A at a position corresponding to position 205; E at a position corresponding to position 205; I at a position corresponding to position 206; A at a position corresponding to position 213; I at a position corresponding to position 219; M at a position corresponding to position 234; T at a position corresponding to position 237; H at a position corresponding to position 238; Q at a position corresponding to position 240; V at a position corresponding to position 249; A at a position corresponding to position 26t; K at a position corresponding to position 261; T at a position corresponding to position 267; K at a position corresponding to position 277; H at a position corresponding to position 279; V at a position corresponding to position 279; V at a position corresponding to position 291; E at a position corresponding to position 309; Q at a position corresponding to position 310; Y at a position corresponding to position 314; Y at a position corresponding to position 315; N at a position corresponding to position 317; W at a position corresponding to position 317; D at a position corresponding to position 318; G at a position corresponding to position 347; A at a position corresponding to position 367; R at a position corresponding to position 375; R at a position corresponding to position 376; V at a position corresponding to position 399; E at a position corresponding to position 401; A at a position corresponding to position 407; L at a position corresponding to position 416; K at a position corresponding to position 419; H at a position corresponding to position 421; E at a position corresponding to position 431; T at a position corresponding to position 433; V at a position corresponding to position 433; C at a position corresponding to position 439; P at a position corresponding to position 440; G at a position corresponding to position 443; and N at a position corresponding to position 445, with reference to amino acid sequence of SEQ ID NO:3.

12. The modified PH20 polypeptide of claim 11, comprising at least one amino acid replacement selected from the group consisting of: T at a position corresponding to position 52, K at a position corresponding to position 58, R at a position corresponding to position 58, P at a position corresponding to position 68, V at a position corresponding to position 83, P at a position corresponding to position 204, A at a position corresponding to position 261, T at a position corresponding to position 267, K at a position corresponding to position 277 and H at a position corresponding to position 421, with reference to amino acid residue positions set forth in SEQ ID NO:3.

13. The modified PH20 polypeptide of claim 12, comprising replacement with R at a position corresponding to position 58 in a PH20 polypeptide with reference to amino acid positions set forth in SEQ ID NO:3.

14. The modified PH20 polypeptide of claim 1 that consists of a sequence of amino acid residues having at least 98% sequence identity to SEQ ID NO:49 and comprises replacement with P at a position corresponding to position 204 in a PH20 polypeptide with reference to amino acid residue positions set forth in SEQ ID NO:49.

15. The modified PH20 polypeptide of claim 1 that is purified or isolated.

16. The modified PH20 polypeptide of claim 1 that is further modified by a modification selected from among glycosylation, sialation, albumination, farnysylation, carboxylation, hydroxylation and phosphorylation.

17. The modified PH20 polypeptide of claim 1, wherein the modified PH20 polypeptide is glycosylated, whereby the polypeptide comprises at least an N-acetylglucosamine moiety linked to each of at least three asparagine (N) residues.

18. The modified PH20 polypeptide of claim 17, wherein the three asparagine residues correspond to amino acid residues 200, 333 and 358 of SEQ ID NO:3.

19. The modified PH20 polypeptide of claim 1 that is modified by conjugation to a polymer.

20. The modified PH20 polypeptide of claim 19, wherein the polymer is dextran or PEG.

21. The modified PH20 polypeptide of claim 1, wherein the modified PH20 polypeptide is conjugated to a moiety selected from among a multimerization domain, toxin, detectable label or drug.

22. A pharmaceutical composition, comprising the modified PH20 polypeptide of claim 1.

23. The pharmaceutical composition of claim 22, wherein the pharmaceutical composition comprises a pharmaceutically acceptable excipient.

24. The pharmaceutical composition of claim 22, comprising an anti-microbially effective amount of a preservative or mixture of preservatives.

25. The pharmaceutical composition of claim 24, comprising at least one phenolic preservative.

26. The pharmaceutical composition of claim 25, wherein the preservative(s) is(are) selected from among phenol, metacresol (m-cresol), benzyl alcohol, and a paraben.

27. The pharmaceutical composition of claim 24, wherein the anti-microbially effective amount is a total amount of one or more preservative agents as a percentage (%) of mass concentration (w/v) that is or is between 0.05% to 0.6%.

28. The pharmaceutical composition of claim 22, comprising a therapeutically active agent.

29. The pharmaceutical composition of claim 28, wherein the therapeutic agent is a polypeptide, a protein, a nucleic acid, a drug, a small molecule or an organic molecule.

30. The pharmaceutical composition of claim 28, wherein the therapeutically active agent is selected from the group consisting of a chemotherapeutic agent, an analgesic agent, an anti-inflammatory agent, an antimicrobial agent, an amoebicidal agent, a trichomonacidal agent, an anti-parkinson agent, an anti-malarial agent, an anticonvulsant agent, an anti-depressant agent, and antiarthritics agent, an antifungal agent, an antihypertensive agent, an antipyretic agent, an anti-parasite agent, an antihistamine agent, an alpha-adrenergic agonist agent, an alpha blocker agent, an anesthetic agent, a bronchial dilator agent, a biocide agent, a bactericide agent, a bacteriostat agent, a beta adrenergic blocker agent, a calcium channel blocker agent, a cardiovascular drug agent, a contraceptive agent, a decongestant agent, a diuretic agent, a depressant agent, a diagnostic agent, a electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sympathomimetic agent, a tranquilizer agent, an urinary agent, a vaginal agent, a viricide agent, a vitamin agent, a non-steroidal anti-inflammatory agent, an angiotensin converting enzyme inhibitor agent, and a sleep inducer.

31. The pharmaceutical composition of claim 28, wherein the therapeutic agent is selected from the group consisting of Adalimumabs, Agalsidase Betas, Alefacepts, Ampicillins, Anakinras, Antipoliomyelitic Vaccines, Anti-Thymocytes, Azithromycins, Becaplermins, Caspofungins, Cefazolins, Cefepimes, Cefotetans, Ceftazidimes, Ceftriaxones, Cetuximabs, Cilastatins, Clavulanic Acids, Clindamycins, Darbepoetin Alfas, Daclizumabs, Diphtheria, Diphtheria antitoxins, Diphtheria Toxoids, Efalizumabs, Epinephrines, Erythropoietin Alphas, Etanercepts, Filgrastims, Fluconazoles, Follicle-Stimulating Hormones, Follitropin Alphas, Follitropin Betas, Fosphenytoins, Gadodiamides, Gadopentetates, Gatifloxacins, Glatiramers, GM-CSFs, Goserelin acetates, Granisetrons, *Haemophilus Influenza* B's, Haloperidols, Hepatitis vaccines, Hepatitis A Vaccines, Hepatiti B Vaccines, Ibritumomab Tiuxetans, Ibritumomabs, Tiuxetans, Immunoglobulins, *Hemophilus influenza* vaccines, Influenza Virus Vaccines, Infliximabs, Insulin lispro, 75% neutral protamine lispro (NPL)/25% insulin lispro, 50% neutral protamine Hagedorn (NPH)/50% regular insulin, 70% NPH/30% regular insulin; Regular insulin, NPH insulin, Ultra insulin, Ultralente insulin, and Insulin Glargines, Interferons, Interferon alpha, Interferon Betas, Interferon Gammas, Interferon alpha-2a, Interferon alpha 2-b, Interferon Alphacon, Interferon alpha-n, Interferon Betas, Interferon Beta-1 a's, Interferon Gammas, Interferon alpha-con, Iodixanols, Iohexols, Iopamidols, Ioversols, Ketorolacs, Laronidases, Levofloxacins, Lidocaines, Linezolids, Lorazepams, Measles Vaccines, Measles virus, Mumps viruses, Measles-Mumps-Rubella Virus Vaccines, Rubella vaccines, Medroxyprogesterones, Meropenems, Methylprednisolones, Midazolams, Morphines, Octreotides, Omalizumabs, Ondansetrons, Palivizumabs, Pantoprazoles, Pegaspargases, Pegfilgrastims, Peg-Interferon Alpha-2a's, Peg-Interferon Alpha-2b's, Pegvisomants, Pertussis vaccines, Piperacillins, Pneumococcal Vaccines and Pneumococcal Conjugate Vaccines, Promethazines, Reteplases, Somatropins, Sulbactams, Sumatriptans, Tazobactams, Tenecteplases, Tetanus Purified Toxoids, Ticarcillins, Tositumomabs, Triamcinolones, Triamcinolone Acetonides, Triamcinolone hexacetonides, Vancomycins, Varicella Zoster immunoglobulins, Varicella vaccines, other vaccines, Alemtuzumabs, Alitretinoins, Allopurinols, Altretamines, Amifostines, Anastrozoles, Arsenics, Arsenic Trioxides, Asparaginases, *Bacillus* Calmette-Guerin (BCG) vaccines, BCG Live, Bexarotenes, Bleomycins, Busulfans, Busulfan intravenous, Busulfan orals, Calusterones, Capecitabines, Carboplatins, Carmustines, Carmustines with Polifeprosans, Celecoxibs, Chlorambucils, Cisplatins, Cladribines, Cyclophosphamides, Cytarabines, Cytarabine liposomals, Dacarbazines, Dactinomycins, Daunorubicin liposomals, Daunorubicins, Denileukin Diftitoxes, Dexrazoxanes, Docetaxels, Doxorubicins, Doxorubicin liposomals, Dromostanolone propionates, Elliotts B Solutions, Epirubicins, Epoetin alfas, Estramustines, Etoposide phosphates, Exemestanes, Floxuridines, Fludarabines, Fluorouracils, Fulvestrants, Gemcitabines, Gemtuzumabs, Ozogamicins, Gemtuzumab ozogamicins, Hydroxyureas, Idarubicins, Ifosfamides, Imatinib mesylates, Irinotecans, Letrozoles, Leucovorins, Levamisoles, Lomustines, Mechlorethamines, Nitrogen mustards, Megestrols, Megestrol acetates, Melphalans, Mercaptopurines, Mesnas, Methotrexates, Methoxsalens, Mitomycins, Mitomycin C's, Mitotanes, Mitoxantrones, Nandrolones, Nandrolone Phenpropionates, Nofetumomabs, Oprelvekins, Oxaliplatins, Paclitaxels, Pamidronates, Pegademases, Pentostatins, Pipobromans, Plicamycins, Porfimer sodiums, Procarbazines, Quinacrines, Rasburicases, Rituximabs, Sargramostims, Streptozocins, Talcs, Tamoxifens, Temozolomides, Teniposides, Testolactones, Thioguanines, Triethylenethiophosphoramides (Thiotepas), Topotecans, Toremifenes, Trastuzumabs, Tretinoins, Uracil Mustards, Valrubicins, Vinblastines, Vincristines, Vinorelbines, Zoledronates, Acivicins, Aclarubicins, Acodazoles, Acronines, Adozelesins, Retinoic Acids, 9-Cis-Retinoic Acids, Alvocidibs, Ambazones, Ambomycins, Ametantrones, Aminoglutethimides, Amsacrines, Anaxirones, Ancitabines, Anthramycins, Apaziquones, Argimesnas, Asperlins, Atrimustines, Azacitidines, Azetepas, Azotomycins, Banoxantrones, Batabulins, Batimastats, Benaxibines, Bendamustines, Benzodepas, Bicalutamides, Bietaserpines, Biricodars, Bisantrenes, Bisnafide Dimesylates, Bizelesins, Bortezomibs, Brequinars, Bropirimines, Budotitanes, Cactinomycins, Canertinibs, Caracemides, Carbetimers, Carboquones, Carmofurs, Carubicins, Carzelesins, Cedefingols, Cemadotins, Cioteronels, Cirolemycins, Clanfenurs, Clofarabines, Crisnatols, Decitabines, Dexniguldipines, Dexormaplatins, Dezaguanines, Diaziquones, Dibrospidiums, Dienogests, Dinalins, Disermolides, Dofequidars, Doxifluridines, Droloxifenes, Duazomycins, Ecomustines, Edatrexates, Edotecarins, Eflomithines, Elacridars, Elinafides, Elsamitrucins, Emitefurs, Enloplatins, Enpromates, Enzastaurins, Epipropidines, Eptaloprosts, Erbulozoles, Esorubicins, Etanidazoles, Etoglucids, Etoprines, Exisulinds, Fadrozotes, Fazarabines, Fenretinides, Fluoxymesterones, Flurocitabines, Fosquidones, Fostriecins, Fotretamines, Galarubicins, Galocitabines, Geroquinols, Gimatecans, Gimeracils, Gloxazones, Glufosfamides, Ilmofosines, Ilomastats, Imexons, Improsulfans, Indisulams, Inproquones, Interleukins, Interleukin-2s, recombinant Interleukins, Intoplicines, Iobenguanes, Iproplatins, Irsogladines, Ixabepilones, Ketotrexates, L-Alanosines, Lanreotides, Lapatinibs, Ledoxantrones, Leuprolides, Lexacalcitols, Liarozoles, Lobaplatins, Lometrexols, Lonafamibs, Losoxantrones, Lurtotecans, Mafosfamides, Mannosulfans, Marimastats, Masoprocols, Maytansines, Melengestrols, Menogarils, Mepitiostanes, Metesinds, Metomidates, Metoprines, Meturedepas, Miboplatins, Miproxifenes, Misonidazoles, Mitindomides, Mitocarcins, Mitocromins, Mitoflaxones, Mitogillins, Mitoguazones, Mitomalcins, Mitonafides, Mitoquidones, Mitospers, Mitozolomides, Mivobulins, Mizoribines, Mofarotenes, Mopidamols, Mubritinibs, Mycophenolic Acids, Nedaplatins, Nelarabines, Nemorubicins, Nitracrines, Nocodazoles, Nogalamycins, Nolatrexeds, Nortopixantrones, Ormaplatins, Ortataxels, Oteracils, Oxisurans, Oxophenarsines, Patupilones, Peldesines, Peliomycins, Pelitrexols, Pemetrexeds, Pentamustines, Peptomycins, Perfosfamides, Perifosines, Picoplatins, Pinafides, Piposulfans, Pirfenidones, Piroxantrones, Pixantrones, Plevitrexeds, Plomestanes, Porfiromycins, Prednimustines, Propamidines, Prospidiums, Pumitepas, Puromycins, Pyrazofurins, Ranimustines, Riboprines, Ritrosulfans, Rogletimides, Roquinimexs, Sabarubicins, Safingols, Satraplatins, Sebriplatins, Semustines, Simtrazenes, Sizofirans, Sobuzoxanes, Sorafenibs, Sparfosates, Sparfosic Acids, Sparsomycins, Spirogermaniums, Spiromustines, Spiroplatins, Squalamines, Streptonigrins, Streptovarycins, Sufosfamides, Sulofenurs, Tacedinalines, Talisomycins, Tallimustines, Tariquidars, Tauromustines, Tecogalans, Tegafurs, Teloxantrones, Temoporfins, Teroxirones, Thiamiprines, Tiamiprines, Tiazofurins, Tilomisoles, Tilorones, Timcodars, Timonacics, Tirapazamines, Topixantrones, Trabectedins, Trestolones, Triciribines, Trilostanes, Trimetrexates, Triplatin Tetranitrates, Triptorelins, Trofosfamides, Tubulozotes, Ubenimexs, Uredepas, Valspodars, Vapreotides, Verteporfins, Vindesines, Vinepidines, Vinflunines, Vinformides, Vinglycinates, Vinleucinols, Vinleurosines, Vinrosidines, Vintriptols, Vinzolidines, Vorozoles, Xanthomycin A's, Guamecyclines, Zeniplatins, Zilascorbs [2-H], Zinostatins, Zorubicins, Zosuquidars, Acetazolamides, Acyclovirs, Adipiodones, Alatrofloxacins, Alfentanils, Allergenic extracts, Alpha 1-proteinase inhibitors, Alprostadils, Amikacins, Amino acids, Aminocaproic acids, Aminophyllines, Amitriptylines, Amobarbitals, Amrinones, Analgesics, Antipoliomyelitic vaccines, Anti-rabic serums, Anti-tetanus immunoglobulins, tetanus vaccines, Antithrombin Ills, Antivenom serums, Argatrobans, Arginines, Ascorbic acids, Atenolols, Atracuriums, Atropines, Aurothioglucoses, Azathioprines, Aztreonams, Bacitracins, Baclofens, Basiliximabs, Benzoic acids, Benztropines, Betamethasones, Biotins, Bivalirudins, Botulism antitoxins, Bretyliums, Bumetanides, Bupivacaines, Buprenorphines, Butorphanols, Calcitonins, Calcitriols, Calciums, Capreomycins, Carboprosts, Carnitines, Cefamandoles, Cefoperazones, Cefotaximes, Cefoxitins, Ceftizoximes, Cefuroximes, Chloramphenicols, Chloroprocaines, Chloroquines, Chlorothiazides, Chlorpromazines, Chondroitinsulfuric acids, Choriogonadotropin alfas, Chromiums, Cidofovirs, Cimetidines, Ciprofloxacins, Cisatracuriums, Clonidines, Codeines, Colchicines, Colistins, Collagens, Corticorelin ovine triflutates, Corticotrophins, Cosyntropins, Cyanocobalamins, Cyclosporines, Cysteines, Dacliximabs, Dalfopristins, Dalteparins, Danaparoids, Dantrolenes, Deferoxamines, Desmopressins, Dexamethasones, Dexmedetomidines, Dexpanthenols, Dextrans, Iron dextrans, Diatrizoic acids, Diazepams, Diazoxides, Dicyclomines, Digibinds, Digoxins, Dihydroergotamines, Diltiazems, Diphenhydramines, Dipyridamoles, Dobutamines, Dopamines, Doxacuriums, Doxaprams, Doxercalciferols, Doxycyclines, Droperidols, Dyphyllines, Edetic acids, Edrophoniums, Enalaprilats, Ephedrines, Epoprostenols, Ergocalciferols, Ergonovines, Ertapenems, Ery~hromycins, Esmolols, Estradiols, Estrogenics, Ethacrynic acids, Ethanolamines, Ethanols, Ethiodized oils, Etidronic acids, Etomidates, Famotidines, Fenoldopams, Fentanyls, Flumazenils, Fluoresceins, Fluphenazines, Folic acids, Fomepizoles, Fomivirsens, Fondaparinuxs, Foscarnets, Fosphenytoins, Furosemides, Gadoteridols, Gadoversetamides, Gancicloviris, Gentamicins, Glucagons, Glucoses, Glycines, Glycopyrrolates, Gonadorelins, Gonadotropin chorionics, *Haemophilus* B polysaccharides, Hemins, Herbals, Histamines, Hydralazines, Hydrocortisones, Hydromorphones, Hydroxocobalamins, Hydroxyzines, Hyoscyamines, Ibutilides, Imiglucerases, Indigo carmines, Indomethacins, Iodides, Iopromides, Iothalamic acids, Ioxaglic acids, Ioxilans, Isoniazids, Isoproterenols, Japanese encephalitis vaccines, Kanamycins, Ketamines, Labetalols, Lepirudins, Levobupivacaines, Levothyroxines, Lincomycins, Liothyronines, Luteinizing hormones, Lyme disease vaccines, Mangafodipirs, Manthtols, Meningococcal polysaccharide vaccines, Meperidines, Mepivacaines, Mesoridazines, Metaraminols, Methadones, Methocarbamols, Methohexitals, Methyldopates, Methylergonovines, Metoclopramides, Metoprolols, Metronidazoles, Minocyclines, Mivacuriums, Morrhuic acids, Moxifloxacins, Muromonab-CD3s, Mycophenolate mofetils, Nafcillins, Nalbuphines, Nalmefenes, Naloxones, Neostigmines, Niacinamides, Nicardipines, Nitroglycerins, Nitroprussides, Norepinephrines, Orphenadrines, Oxacillins, Oxymorphones, Oxytetracyclines, Oxytocins, Pancuroniums, Panthenols, Pantothenic acids, Papaverines, Peginterferon alpha 2As, Penicillin Gs, Pentamidines, Pentazocines, Pentobarbitals, Perflutrens, Perphenazines, Phenobarbitals, Phentolamines, Phenylephrines, Phenytoins, Physostigmines, Phytonadiones, Polymyxin, Pralidoximes, Prilocaines, Procainamides, Procaines, Prochlorperazines, Progesterones, Propranolols, Pyridostigmine hydroxides, Pyridoxines, Quinidines, Quinupristins, Rabies immunoglobulins, Rabies vaccines, Ranitidines, Remifentanils, Riboflavins, Rifampins, Ropivacaines, Samariums, Scopolamines, Seleniums, Sermorelins, Sincalides, Somatrems, Spectinomycins, Streptokinases, Streptomycins, Succinylcholines, Sufentanils, Sulfamethoxazoles, Tacrolimuses, Terbutalines, Teriparatides, Testosterones, Tetanus antitoxins, Tetracaines, Tetradecyl sulfates, Theophyllines, Thiamines, Thiethylperazines, Thiopentals, Thyroid stimulating hormones, Tinzaparins, Tirofibans, Tobramycins, Tolazolines, Tolbutamides, Torsemides, Tranexamic acids, Treprostinils, Trifluoperazines, Trimethobenzamides, Trimethoprims, Tromethamines, Tuberculins, Typhoid vaccines, Urofollitropins, Urokinases, Valproic acids, Vasopressins, Vecuroniums, Verapamils, Voriconazoles, Warfarins, Yellow fever vaccines, Zidovudines, Zincs, Ziprasidone hydrochlorides, Aclacinomycins, Actinomycins, Adriamycins, Azaserines, 6-Azauridines, Carzinophilins, Chromomycins, Denopterins, 6 Diazo 50xo-L-Norleucines, Enocitabines, Floxuridines, Olivomycins, Pirarubicins, Piritrexims, Pteropterins, Tegafurs, Tubercidins, Alteplases, Arcitumomabs, bevacizumabs, Botulinum Toxin Type A's, Botulinum Toxin Type B's, Capromab Pendetides, Daclizumabs, Dornase alphas, Drotrecogin alphas, Imciromab Pentetates, Iodine-131's, an antibiotic agent; an angiogenesis inhibitor; anti-cataract and anti-diabetic retinopathy substances; carbonic anhydrase inhibitors; mydriatics; photodynamic therapy agents; prostaglandin analogs; growth factor; anti-neoplastics; anti-metabolites; anti-viral; amebicides and anti-protozoals; anti-tuberculosis and anti-leprotic; antitoxins and antivenins; antihemophilic factor, anti-inhibitor coagulant complex, antithrombin III, coagulations Factor V, coagulation Factor IX, plasma protein fraction, von Willebrand factor; antiplatelet agent a colony stimulating factor (CSF); an erythropoiesis stimulator; hemostatics and albumins; Immune Globulins; thrombin inhibitors; anticoagulants; a steroidal anti-inflammatory drug selected from among alclometasones, algestones, beclomethasones, betamethasones, budesonides, clobetasols, clobetasones, clocortolones, cloprednols, corticosterones, col~isones, cortivazols, deflazacorts, desonides, desoximetasones, dexamethasones, diflorasones, diflucortolones, difluprednates, enoxolones, fluazacorts, flucloronides, flumethasones, flunisolides, fluocinolones, fluocinonides, fluocortins, fluocortolones, fluorometholones, fluperolones, fluprednidenes, fluprednisolones, flurandrenolides, fluticasones, formocortals, halcinonides, halobetasols, halometasones, halopredones, hydrocortamates, hydrocortisones, loteprednol etabonate, mazipredones, medrysones, meprednisones, methylprednisolones, mometasone furoate, paramethasones, prednicarbates, prednisolones, prednisones, prednivals, prednylidenes, rimexolones, tixocortols and triamcinolones; docosenoid, prostaglandins, prostaglandin analogs, antiprostaglandins and prostaglandin precursors; miotics, cholinergics and anti-cholinesterase; and anti-allergenics.

32. The pharmaceutical composition of claim 28, wherein the therapeutic agent is selected from the group consisting of an antibody, an Immune Globulin, a bisphosphonate, a cytokine, a chemotherapeutic agent, a coagulation factor and an insulin.

33. The pharmaceutical composition of claim 32, wherein the therapeutic agent is an insulin that is a fast-acting insulin.

34. The pharmaceutical composition of claim 33, wherein the fast-acting insulin is regular insulin or is an insulin analog.

35. The pharmaceutical composition of claim 34, wherein the fast-acting insulin is a regular insulin that is a human insulin or a pig insulin.

36. The pharmaceutical composition of claim 35, wherein:
the fast-acting insulin comprises an A chain having the sequence of amino acids set forth in SEQ ID NO:862 and a B chain having the sequence of amino acids set forth in SEQ ID NO:863; or
the fast-acting insulin comprises an A chain with the sequence of amino acids set forth as amino acid residue positions 88-108 of SEQ ID NO:864 and a B chain with the sequence of amino acids set forth as amino acid residue positions 25-54 of SEQ ID NO:864.

37. The pharmaceutical composition of claim 34, wherein the fast-acting insulin is an insulin analog selected from among insulin lispro, insulin aspart and insulin glulisine.

38. The pharmaceutical composition of claim 37, wherein the insulin analog is an insulin having an A chain with the sequence of amino acids set forth in SEQ ID NO:862 and a B chain having the sequence of amino acids set forth in any of SEQ NOS:865-867.

39. The pharmaceutical composition of claim 33, wherein:
the amount of the modified PH20 polypeptide is from about 100 U/mL to 1000 U/mL; and
the amount of the fast-acting insulin is from about 10 U/mL to 1000 U/mL.

40. The pharmaceutical composition of claim 39, further comprising:
a pH from about 7.0 to 7.6;
NaCl at a concentration from about 0.1 mM to 200 mM; and
an anti-microbially effective amount of one or more preservatives, wherein at least one preservative is a phenolic preservative.

41. The pharmaceutical composition of claim 40, wherein the anti-microbially effective amount is a total amount of one or more preservative agents as a percentage (%) of mass concentration (w/v) that is between 0.05% to 0.6%, inclusive.

42. The pharmaceutical composition of claim 40, wherein the preservative(s) is(are) selected from the group consisting of phenol, metacresol (m-cresol), benzyl alcohol, and a paraben.

43. The pharmaceutical composition of claim 40, further comprising: a surfactant in an amount as a percentage (%) of mass concentration (w/v) in the formulation composition that is at least or at least about 0.001%; a buffering agent that is a non-metal binding agent or is a metal binding agent, wherein the concentration of the buffering agent is between about 1 mM to 100 mM; glycerin in a concentration less than 60 mM; an antioxidant at a concentration between about 2 mM to 50 mM; and/or zinc at a concentration of between about 0.001 to 0.1 mg per 100 units of insulin (mg/100 U).

44. The pharmaceutical composition of claim 43, wherein the surfactant is selected from the group consisting of a polypropylene glycol, polyethylene glycol, glycerin, sorbitol, poloxamer and polysorbate.

45. The pharmaceutical composition of claim 43, wherein the buffering agent is selected from the group consisting of Tris, histidine, phosphate and citrate.

46. The pharmaceutical composition of claim 43, wherein the antioxidant is selected from the group consisting of cysteine, tryptophan and methionine.

47. A closed loop system, comprising the pharmaceutical composition of claim 33.

48. An insulin pump, comprising the pharmaceutical composition of claim 33.

49. An insulin pen, comprising the pharmaceutical composition of claim 33.

* * * * *

UNITED STATES PATENT AND TRADEMARK OFFICE
CERTIFICATE OF CORRECTION

PATENT NO. : 9,447,401 B2
APPLICATION NO. : 13/694731
DATED : September 20, 2016
INVENTOR(S) : Wei et al.

It is certified that error appears in the above-identified patent and that said Letters Patent is hereby corrected as shown below:

On the Title Page

The first or sole Notice should read --

Subject to any disclaimer, the term of this patent is extended or adjusted under 35 U.S.C. 154(b) by 429 days.

In Item (56) References Cited, in OTHER PUBLICATIONS, on page 2, 2nd Column, Line 55, please replace "Schanteet al" with the author's last name —Schanté et al—.

In Item (56) References Cited, in OTHER PUBLICATIONS, on page 6, 2nd Column, Line 12, please replace "Steinlcuhler" with the author's last name —Steinkuhler—.

In Item (56) References Cited, in OTHER PUBLICATIONS, on page 7, 1st Column, Line 72, please replace "PinIcstaff" with the author's last name —Pinkstaff—.

In Item (56) References Cited, in OTHER PUBLICATIONS, on page 7, 2nd Column, Line 67, please replace "postnataal" with —postnatal—.

In the Specification

At Column 30, Line 6, please replace ", months" with —, 25 months—.

At Column 30, Line 13, please replace ", days" with —, 30 days—.

At Column 32, Line 46, please replace "Fosphenyloins" with —Fosphenytoins—.

At Column 32, Line 61, please replace "Iohexyls" with —Iohexols—.

Signed and Sealed this
Twenty-eighth Day of March, 2017

Michelle K. Lee
*Director of the United States Patent and Trademark Office*

CERTIFICATE OF CORRECTION (continued)
U.S. Pat. No. 9,447,401 B2

At Column 35, Line 13, please replace "Fosphenyloins" with —Fosphenytoins—.

At Column 35, Line 40, please replace "Phenyloins" with —Phenytoins—.

At Column 35, Line 41, please replace "Prilocalnes" with —Prilocaines—.

At Column 47, Line 27, please replace "pi" with —pI—.

At Column 88, Line 33, please replace "1271" with —I271—.

At Column 137, Line 64, please replace "997" with —1997—.

At Column 142, Line 24, please replace "963" with —1963—.

At Column 143, Line 65, please replace "75:5543" with —78:5543—.

At Column 144, Line 4, please replace "305:209" with —303:209—.

At Column 144, Line 15, please replace "55:639" with —38:639—.

At Column 144, Line 19, please replace "375:115" with —315:115—.

At Column 144, Line 21, please replace "55:647" with —38:647—.

At Column 144, Line 22, please replace "575:533" with —318:533—.

At Column 144, Line 27, please replace "7:268" with —1:268—.

At Column 144, Line 30, please replace "255:53" with —235:53—.

At Column 144, Line 32, please replace "7:161" with —1:161—.

At Column 144, Line 34, please replace "575:338" with —315:338—.

At Column 144, Line 37, please replace "45:703" with —48:703—.f

At Column 144, Line 39, please replace "574:283" with —314:283—.

At Column 149, Line 26, please replace "54:332" with —84:332—.

At Column 174, Line 16, please replace "tri-cresol" with —m-cresol—.

At Column 186, Line 21, please replace "Fosphenyloins" with —Fosphenytoins—.

CERTIFICATE OF CORRECTION (continued)
U.S. Pat. No. 9,447,401 B2

At Column 186, Line 33, please replace "Iohexyls" with —Iohexols—.

At Column 188, Line 52, please replace "Fosphenyloins" with —Fosphenytoins—.

At Column 189, Line 12, please replace "Phenyloins" with —Phenytoins—.

At Column 189, Line 13, please replace "Prilocalnes" with —Prilocaines—.

In the Claims

At Column 318, Line 37 to Column 319, Line 47, should read:
11. The modified PH20 polypeptide of claim 10, comprising at least one amino acid replacement selected from the group consisting of: G at a position corresponding to position 10; K at a position corresponding to position 12; S at a position corresponding to position 20; T at a position corresponding to position 22; M at a position corresponding to position 26; W at a position corresponding to position 34; N at a position corresponding to position 36; L at a position corresponding to position 46; M at a position corresponding to position 50; T at a position corresponding to position 52; S at a position corresponding to position 52; C at a position corresponding to position 58; K at a position corresponding to position 58; R at a position corresponding to position 58; N at a position corresponding to position 58; Y at a position corresponding to position 58; P at a position corresponding to position 58; H at a position corresponding to position 58; P at a position corresponding to position 68; V at a position corresponding to position 70; E at a position corresponding to position 74; L at a position corresponding to position 82; N at a position corresponding to position 82; V at a position corresponding to position 83; Q at a position corresponding to position 83; S at a position corresponding to position 83; G at a position corresponding to position 83; N at a position corresponding to position 84; A at a position corresponding to position 86; K at a position corresponding to position 86; E at a position corresponding to position 97; L at a position corresponding to position 97; R at a position corresponding to position 127; R at a position corresponding to position 131; L at a position corresponding to position 138; K at a position corresponding to position 142; N at a position corresponding to position 142; P at a position corresponding to position 142; S at a position corresponding to position 142; T at a position corresponding to position 142; G at a position corresponding to position 143; K at a position corresponding to position 143; T at a position corresponding to position 144; Q at a position corresponding to position 166; T at a position corresponding to position 166; L at a position corresponding to position 169; G at a position corresponding to position 174; N at a position corresponding to position 174; Q at a position corresponding to position 193; T at a position corresponding to position 195; N at a position corresponding to position 195; E at a position corresponding to position 196; R at a position corresponding to position 196; A at a position corresponding to position 205; E at a position corresponding to position 205; I at a position corresponding to position 206; A at a position corresponding to position 213; I at a position corresponding to position 219; M at a position corresponding to position 234; T at a position corresponding to position 237; H at a position corresponding to position 238; Q at a position corresponding to position 240; V at a position corresponding to position 249; A at a position corresponding to position 261; K at a position corresponding to position 261; T at a position corresponding to position 267; K at a position corresponding to position 277; H at a position corresponding to position 279; V at a position corresponding to position 279; V at a position corresponding to position 291; E at a position corresponding to position 309; Q at a position corresponding to position 310; Y at a position corresponding to position 314; Y at a position corresponding to position 315; N at a position corresponding to position 317; W at a position corresponding to position 317; D at a position corresponding to position 318; G at a position corresponding to position 347; A at a position corresponding to position 367; R at a position corresponding to position 375; R at a position corresponding to position 376; V at a position corresponding to position 399; E at a position corresponding to position 401; A at a position corresponding to position 407; L at a position corresponding to position 416; K at a position corresponding to position 419; H at a position corresponding to position 421; E at a position corresponding to position 431; T at a position corresponding to position 433; V at a position corresponding to position 433; C at a position corresponding to position 439; P at a position corresponding to position 440; G at a position corresponding to position 443; and N at a position corresponding to position 445, with reference to amino acid sequence of SEQ ID NO:3.

At Column 321, Line 4 to Column 324, Line 62, should read:
31. The pharmaceutical composition of claim 28, wherein the therapeutic agent is selected from the group consisting of Adalimumabs, Agalsidase Betas, Alefacepts, Ampicillins, Anakinras, Antipoliomyelitic Vaccines, Anti-Thymocytes, Azithromycins, Becaplermins, Caspofungins, Cefazolins, Cefepimes, Cefotetans, Ceftazidimes, Ceftriaxones, Cetuximabs, Cilastatins, Clavulanic Acids, Clindamycins, Darbepoetin Alfas, Daclizumabs, Diphtheria, Diphtheria antitoxins, Diphtheria Toxoids, Efalizumabs, Epinephrines, Erythropoietin Alphas, Etanercepts, Filgrastims, Fluconazoles, Follicle-Stimulating Hormones, Follitropin Alphas, Follitropin Betas, Fosphenytoins, Gadodiamides, Gadopentetates, Gatifloxacins, Glatiramers, GM-CSF's, Goserelin acetates, Granisetrons, Haemophilus Influenza B's, Haloperidols, Hepatitis vaccines, Hepatitis A Vaccines, Hepatitis B Vaccines, Ibritumomab Tiuxetans, Ibritumomabs, Tiuxetans, Immunoglobulins, Hemophilus influenza vaccines, Influenza Virus Vaccines, Infliximabs, Insulin lispro, 75% neutral protamine lispro (NPL)/25% insulin lispro, 50% neutral protamine Hagedorn (NPH)/ 50% regular insulin, 70% NPH/30% regular insulin; Regular insulin, NPH insulin, Ultra insulin, Ultralente insulin, and Insulin Glargines, Interferons, Interferon alpha, Interferon Betas, Interferon Gammas, Interferon alpha-2a, Interferon alpha 2-b, Interferon Alphacon, Interferon alpha-n, Interferon Betas, Interferon Beta-1a's, Interferon Gammas, Interferon alpha-con, Iodixanols, Iohexols, Iopamidols, Ioversols, Ketorolacs, Laronidases, Levofloxacins, Lidocaines, Linezolids, Lorazepams, Measles Vaccines, Measles virus, Mumps viruses, Measles-Mumps-Rubella Virus Vaccines, Rubella vaccines, Medroxyprogesterones, Meropenems, Methylprednisolones, Midazolams, Morphines, Octreotides, Omalizumabs,

CERTIFICATE OF CORRECTION (continued)
U.S. Pat. No. 9,447,401 B2

Ondansetrons, Palivizumabs, Pantoprazoles, Pegaspargases, Pegfilgrastims, Peg-Interferon Alpha-2a's, Peg-Interferon Alpha-2b's, Pegvisomants, Pertussis vaccines, Piperacillins, Pneumococcal Vaccines and Pneumococcal Conjugate Vaccines, Promethazines, Reteplases, Somatropins, Sulbactams, Sumatriptans, Tazobactams, Tenecteplases, Tetanus Purified Toxoids, Ticarcillins, Tositumomabs, Triamcinolones, Triamcinolone Acetonides, Triamcinolone hexacetonides, Vancomycins, Varicella Zoster immunoglobulins, Varicella vaccines, other vaccines, Alemtuzumabs, Alitretinoins, Allopurinols, Altretamines, Amifostines, Anastrozoles, Arsenics, Arsenic Trioxides, Asparaginases, Bacillus Calmette-Guerin (BCG) vaccines, BCG Live, Bexarotenes, Bleomycins, Busulfans, Busulfan intravenous, Busulfan orals, Calusterones, Capecitabines, Carboplatins, Carmustines, Carmustines with Polifeprosans, Celecoxibs, Chlorambucils, Cisplatins, Cladribines, Cyclophosphamides, Cytarabines, Cytarabine liposomals, Dacarbazines, Dactinomycins, Daunorubicin liposomals, Daunorubicins, Denileukin Diftitoxes, Dexrazoxanes, Docetaxels, Doxorubicins, Doxorubicin liposomals, Dromostanolone propionates, Elliott's B Solutions, Epirubicins, Epoetin alfas, Estramustines, Etoposide phosphates, Exemestanes, Floxuridines, Fludarabines, Fluorouracils, Fulvestrants, Gemcitabines, Gemtuzumabs, Ozogamicins, Gemtuzumab ozogamicins, Hydroxyureas, Idarubicins, Ifosfamides, Imatinib mesylates, Irinotecans, Letrozoles, Leucovorins, Levamisoles, Lomustines, Mechlorethamines, Nitrogen mustards, Megestrols, Megestrol acetates, Melphalans, Mercaptopurines, Mesnas, Methotrexates, Methoxsalens, Mitomycins, Mitomycin C's, Mitotanes, Mitoxantrones, Nandrolones, Nandrolone Phenpropionates, Nofetumomabs, Oprelvekins, Oxaliplatins, Paclitaxels, Pamidronates, Pegademases, Pentostatins, Pipobromans, Plicamycins, Porfimer sodiums, Procarbazines, Quinacrines, Rasburicases, Rituximabs, Sargramostims, Streptozocins, Talcs, Tamoxifens, Temozolomides, Teniposides, Testolactones, Thioguanines, Triethylenethiophosphoramides (Thiotepas), Topotecans, Toremifenes, Trastuzumabs, Tretinoins, Uracil Mustards, Valrubicins, Vinblastines, Vincristines, Vinorelbines, Zoledronates, Acivicins, Aclarubicins, Acodazoles, Acronines, Adozelesins, Retinoic Acids, 9-Cis-Retinoic Acids, Alvocidibs, Ambazones, Ambomycins, Ametantrones, Aminoglutethimides, Amsacrines, Anaxirones, Ancitabines, Anthramycins, Apaziquones, Argimesnas, Asperlins, Atrimustines, Azacitidines, Azetepas, Azotomycins, Banoxantrones, Batabulins, Batimastats, Benaxibines, Bendamustines, Benzodepas, Bicalutamides, Bietaserpines, Biricodars, Bisantrenes, Bisnafide Dimesylates, Bizelesins, Bortezomibs, Brequinars, Bropirimines, Budotitanes, Cactinomycins, Canertinibs, Caracemides, Carbetimers, Carboquones, Carmofurs, Carubicins, Carzelesins, Cedefingols, Cemadotins, Cioteronels, Cirolemycins, Clanfenurs, Clofarabines, Crisnatols, Decitabines, Dexniguldipines, Dexormaplatins, Dezaguanines, Diaziquones, Dibrospidiums, Dienogests, Dinalins, Disermolides, Dofequidars, Doxifluridines, Droloxifenes, Duazomycins, Ecomustines, Edatrexates, Edotecarins, Eflomithines, Elacridars, Elinafides, Elsamitrucins, Emitefurs, Enloplatins, Enpromates, Enzastaurins, Epipropidines, Eptaloprosts, Erbulozoles, Esorubicins, Etanidazoles, Etoglucids, Etoprines, Exisulinds, Fadrozoles, Fazarabines, Fenretinides, Fluoxymesterones, Flurocitabines, Fosquidones,

CERTIFICATE OF CORRECTION (continued)
U.S. Pat. No. 9,447,401 B2

Fostriecins, Fotretamines, Galarubicins, Galocitabines, Geroquinols, Gimatecans, Gimeracils, Gloxazones, Glufosfamides, Ilmofosines, Ilomastats, Imexons, Improsulfans, Indisulams, Inproquones, Interleukins, Interleukin-2s, recombinant Interleukins, Intoplicines, Iobenguanes, Iproplatins, Irsogladines, Ixabepilones, Ketotrexates, L-Alanosines, Lanreotides, Lapatinibs, Ledoxantrones, Leuprolides, Lexacalcitols, Liarozoles, Lobaplatins, Lometrexols, Lonafarnibs, Losoxantrones, Lurtotecans, Mafosfamides, Mannosulfans, Marimastats, Masoprocols, Maytansines, Melengestrols, Menogarils, Mepitiostanes, Metesinds, Metomidates, Metoprines, Meturedepas, Miboplatins, Miproxifenes, Misonidazoles, Mitindomides, Mitocarcins, Mitocromins, Mitoflaxones, Mitogillins, Mitoguazones, Mitomalcins, Mitonafides, Mitoquidones, Mitospers, Mitozolomides, Mivobulins, Mizoribines, Mofarotenes, Mopidamols, Mubritinibs, Mycophenolic Acids, Nedaplatins, Nelarabines, Nemorubicins, Nitracrines, Nocodazoles, Nogalamycins, Nolatrexeds, Nortopixantrones, Ormaplatins, Ortataxels, Oteracils, Oxisurans, Oxophenarsines, Patupilones, Peldesines, Peliomycins, Pelitrexols, Pemetrexeds, Pentamustines, Peplomycins, Perfosfamides, Perifosines, Picoplatins, Pinafides, Piposulfans, Pirfenidones, Piroxantrones, Pixantrones, Plevitrexeds, Plomestanes, Porfiromycins, Prednimustines, Propamidines, Prospidiums, Pumitepas, Puromycins, Pyrazofurins, Ranimustines, Riboprines, Ritrosulfans, Rogletimides, Roquinimexs, Sabarubicins, Safingols, Satraplatins, Sebriplatins, Semustines, Simtrazenes, Sizofirans, Sobuzoxanes, Sorafenibs, Sparfosates, Sparfosic Acids, Sparsomycins, Spirogermaniums, Spiromustines, Spiroplatins, Squalamines, Streptonigrins, Streptovarycins, Sufosfamides, Sulofenurs, Tacedinalines, Talisomycins, Tallimustines, Tariquidars, Tauromustines, Tecogalans, Tegafurs, Teloxantrones, Temoporfins, Teroxirones, Thiamiprines, Tiamiprines, Tiazofurins, Tilomisoles, Tilorones, Timcodars, Timonacics, Tirapazamines, Topixantrones, Trabectedins, Trestolones, Triciribines, Trilostanes, Trimetrexates, Triplatin Tetranitrates, Triptorelins, Trofosfamides, Tubulozoles, Ubenimexs, Uredepas, Valspodars, Vapreotides, Verteporfins, Vindesines, Vinepidines, Vinflunines, Vinformides, Vinglycinates, Vinleucinols, Vinleurosines, Vinrosidines, Vintriptols, Vinzolidines, Vorozoles, Xanthomycin A's, Guamecyclines, Zeniplatins, Zilascorbs [2-H], Zinostatins, Zorubicins, Zosuquidars, Acetazolamides, Acyclovirs, Adipiodones, Alatrofloxacins, Alfentanils, Allergenic extracts, Alpha 1-proteinase inhibitors, Alprostadils, Amikacins, Amino acids, Aminocaproic acids, Aminophyllines, Amitriptylines, Amobarbitals, Amrinones, Analgesics, Anti-poliomyelitic vaccines, Anti-rabic serums, Anti-tetanus immunoglobulins, tetanus vaccines, Antithrombin IIIs, Antivenom serums, Argatrobans, Arginines, Ascorbic acids, Atenolols, Atracuriums, Atropines, Aurothioglucoses, Azathioprines, Aztreonams, Bacitracins, Baclofens, Basiliximabs, Benzoic acids, Benztropines, Betamethasones, Biotins, Bivalirudins, Botulism antitoxins, Bretyliums, Bumetanides, Bupivacaines, Buprenorphines, Butorphanols, Calcitonins, Calcitriols, Calciums, Capreomycins, Carboprosts, Carnitines, Cefamandoles, Cefoperazones, Cefotaximes, Cefoxitins, Ceftizoximes, Cefuroximes, Chloramphenicols, Chloroprocaines, Chloroquines, Chlorothiazides, Chlorpromazines, Chondroitinsulfuric acids, Choriogonadotropin alfas, Chromiums, Cidofovirs, Cimetidines, Ciprofloxacins, Cisatracuriums, Clonidines, Codeines, Colchicines, Colistins, Collagens, Corticorelin ovine triflutates, Corticotrophins, Cosyntropins, Cyanocobalamins, Cyclosporines, Cysteines, Dacliximabs, Dalfopristins, Dalteparins, Danaparoids, Dantrolenes, Deferoxamines, Desmopressins, Dexamethasones, Dexmedetomidines, Dexpanthenols, Dextrans, Iron dextrans, Diatrizoic acids, Diazepams, Diazoxides, Dicyclomines, Digibinds, Digoxins, Dihydroergotamines, Diltiazems, Diphenhydramines, Dipyridamoles, Dobutamines, Dopamines, Doxacuriums, Doxaprams, Doxercalciferols, Doxycyclines, Droperidols, Dyphyllines, Edetic acids, Edrophoniums, Enalaprilats, Ephedrines, Epoprostenols, Ergocalciferols, Ergonovines, Ertapenems, Erythromycins, Esmolols, Estradiols, Estrogenics, Ethacrynic acids, Ethanolamines, Ethanols, Ethiodized oils, Etidronic acids, Etomidates, Famotidines, Fenoldopams, Fentanyls, Flumazenils, Fluoresceins, Fluphenazines, Folic acids, Fomepizoles, Fomivirsens, Fondaparinuxs, Foscarnets, Fosphenytoins, Furosemides, Gadoteridols, Gadoversetamides, Ganciclovirs, Gentamicins, Glucagons, Glucoses, Glycines, Glycopyrrolates, Gonadorelins, Gonadotropin chorionics, Haemophilus B polysaccharides, Hemins, Herbals, Histamines, Hydralazines, Hydrocortisones, Hydromorphones, Hydroxocobalamins, Hydroxyzines, Hyoscyamines, Ibutilides, Imiglucerases, Indigo carmines, Indomethacins, Iodides, Iopromides, Iothalamic acids, Ioxaglic acids, Ioxilans, Isoniazids, Isoproterenols, Japanese encephalitis vaccines, Kanamycins, Ketamines, Labetalols, Lepirudins, Levobupivacaines, Levothyroxines, Lincomycins, Liothyronines, Luteinizing hormones, Lyme disease vaccines, Mangafodipirs, Manthtols, Meningococcal polysaccharide vaccines, Meperidines, Mepivacaines, Mesoridazines, Metaraminols, Methadones, Methocarbamols, Methohexitals, Methyldopates, Methylergonovines, Metoclopramides, Metoprolols, Metronidazoles, Minocyclines, Mivacuriums, Morrhuic acids, Moxifloxacins, Muromonab-CD3s, Mycophenolate mofetils, Nafcillins, Nalbuphines, Nalmefenes, Naloxones, Neostigmines, Niacinamides, Nicardipines, Nitroglycerins, Nitroprussides, Norepinephrines, Orphenadrines, Oxacillins, Oxymorphones, Oxytetracyclines, Oxytocins, Pancuroniums, Panthenols, Pantothenic acids, Papaverines, Peginterferon alpha 2As, Penicillin Gs, Pentamidines, Pentazocines, Pentobarbitals, Perflutrens, Perphenazines, Phenobarbitals, Phentolamines, Phenylephrines, Phenytoins, Physostigmines, Phytonadiones, Polymyxin, Pralidoximes, Prilocaines, Procainamides, Procaines, Prochlorperazines, Progesterones, Propranolols, Pyridostigmine hydroxides, Pyridoxines, Quinidines, Quinupristins, Rabies immunoglobulins, Rabies vaccines, Ranitidines, Remifentanils, Riboflavins, Rifampins, Ropivacaines, Samariums, Scopolamines, Seleniums, Sermorelins, Sincalides, Somatrems, Spectinomycins, Streptokinases, Streptomycins, Succinylcholines, Sufentanils, Sulfamethoxazoles, Tacrolimuses, Terbutalines, Teriparatides, Testosterones, Tetanus antitoxins, Tetracaines, Tetradecyl sulfates, Theophyllines, Thiamines, Thiethylperazines, Thiopentals, Thyroid stimulating hormones, Tinzaparins, Tirofibans, Tobramycins, Tolazolines, Tolbutamides, Torsemides, Tranexamic acids, Treprostinils, Trifluoperazines, Trimethobenzamides, Trimethoprims, Tromethamines, Tuberculins, Typhoid vaccines, Urofollitropins, Urokinases, Valproic acids, Vasopressins, Vecuroniums, Verapamils, Voriconazoles, Warfarins, Yellow fever vaccines, Zidovudines, Zincs, Ziprasidone hydrochlorides, Aclacinomycins, Actinomycins, Adriamycins, Azaserines, 6-Azauridines, Carzinophilins, Chromomycins, Denopterins, 6 Diazo 5 Oxo-L-Norleucines, Enocitabines, Floxuridines, Olivomycins, Pirarubicins, Piritrexims, Pteropterins, Tegafurs, Tubercidins, Alteplases, Arcitumomabs, bevacizumabs, Botulinum Toxin Type A's, Botulinum Toxin Type B's, Capromab Pendetides, Daclizumabs, Dornase alphas, Drotrecogin alphas, Imciromab Pentetates, Iodine-131's, an antibiotic agent; an angiogenesis inhibitor; anti-cataract and anti-diabetic retinopathy substances; carbonic anhydrase inhibitors; mydriatics; photodynamic therapy agents; prostaglandin analogs; growth factor; anti-neoplastics; anti-metabolites; anti-viral; amebicides and anti-protozoals; anti-tuberculosis and anti-leprotic; antitoxins and antivenins; antihemophilic factor, anti-inhibitor coagulant complex, antithrombin III, coagulations Factor V, coagulation Factor IX, plasma protein fraction, von Willebrand factor; antiplatelet agent a colony stimulating factor (CSF); an erythropoiesis stimulator; hemostatics and albumins; Immune Globulins; thrombin inhibitors; anticoagulants; a steroidal anti-inflammatory drug selected from among alclometasones, algestones, beclomethasones, betamethasones, budesonides, clobetasols, clobetasones, clocortolones, cloprednols, corticosterones, cortisones, cortivazols, deflazacorts, desonides, desoximetasones, dexamethasones, diflorasones, diflucortolones, difluprednates, enoxolones, fluazacorts, flucloronides, flumethasones, flunisolides, fluocinolones, fluocinonides, fluocortins, fluocortolones, fluorometholones, fluperolones, fluprednidenes, fluprednisolones, flurandrenolides, fluticasones, formocortals, halcinonides, halobetasols, halometasones, halopredones, hydrocortamates, hydrocortisones, loteprednol etabonate, mazipredones, medrysones, meprednisones, methylprednisolones, mometasone furoate, paramethasones, prednicarbates, prednisolones, prednisones, prednivals, prednylidenes, rimexolones, tixocortols and triamcinolones; Docosenoid, prostaglandins, prostaglandin analogs, antiprostaglandins and prostaglandin precursors; miotics, cholinergics and anti-cholinesterase; and anti-allergenics.

At Column 325, Line 28 to Line 33, should read:
39. The pharmaceutical composition of claim 33, wherein:
the amount of the modified PH20 polypeptide is from or from about 100 U/mL to 1000 U/mL; and
the amount of the fast-acting insulin is from or from about 10 U/mL to 1000 U/mL.

At Column 325, Line 34 to Column 326, Line 3, should read:
40. The pharmaceutical composition of claim 39, further comprising:
a pH from or from about 7.0 to 7.6;
NaCl at a concentration from or from about 0.1 mM to 200 mM; and
an anti-microbially effective amount of one or more preservatives, wherein at least one preservative is a phenolic preservative.

CERTIFICATE OF CORRECTION (continued)
U.S. Pat. No. 9,447,401 B2

At Column 326, Line 13 to Line 22, should read:
43. The pharmaceutical composition of claim 40, further comprising:
a surfactant in an amount as a percentage (%) of mass concentration (w/v) in the composition that is at least or at least about 0.001%;
a buffering agent that is a non-metal binding agent or is a metal binding agent, wherein the concentration of the buffering agent is between about 1 mM to 100 mM;
glycerin in a concentration less than 60 mM;
an antioxidant at a concentration between about 2 mM to 50 mM;
and/or zinc at a concentration between about 0.001 to 0.1 mg per 100 units of insulin (mg/100U).